US011572565B2

(12) United States Patent
Wong et al.

(10) Patent No.: US 11,572,565 B2
(45) Date of Patent: Feb. 7, 2023

(54) INDUCIBLE CONTROL OF GENE EXPRESSION

(71) Applicant: TRUSTEES OF BOSTON UNIVERSITY, Boston, MA (US)

(72) Inventors: Wilson Wai Chun Wong, Brookline, MA (US); Yage Ding, Allston, MA (US)

(73) Assignee: TRUSTEES OF BOSTON UNIVERSITY, Boston, MA (US)

( * ) Notice: Subject to any disclaimer, the term of this patent is extended or adjusted under 35 U.S.C. 154(b) by 0 days.

(21) Appl. No.: 17/381,780

(22) Filed: Jul. 21, 2021

(65) Prior Publication Data

US 2022/0025381 A1 Jan. 27, 2022

Related U.S. Application Data

(60) Provisional application No. 63/054,446, filed on Jul. 21, 2020.

(51) Int. Cl.
*C12N 15/63* (2006.01)
*C12N 9/12* (2006.01)
*C12N 9/22* (2006.01)

(52) U.S. Cl.
CPC ........... *C12N 15/63* (2013.01); *C12N 9/1241* (2013.01); *C12N 9/22* (2013.01)

(58) Field of Classification Search
CPC ....................................................... C12N 9/22
See application file for complete search history.

(56) References Cited

U.S. PATENT DOCUMENTS

| | | | |
|---|---|---|---|
| 6,333,186 B1 | 12/2001 | Wittekind et al. | |
| 7,208,309 B2 | 4/2007 | Kukolj et al. | |
| 7,494,660 B2 | 2/2009 | Lin et al. | |
| 8,735,096 B2 | 5/2014 | Zhou et al. | |
| 10,590,182 B2 | 3/2020 | Lim et al. | |
| 2002/0106642 A1 | 8/2002 | Wittekind et al. | |
| 2014/0234851 A1 | 8/2014 | Leonard et al. | |
| 2016/0177278 A1* | 6/2016 | Wolfe | C12N 9/22 435/199 |
| 2017/0183654 A1 | 6/2017 | Wong et al. | |
| 2018/0066242 A1 | 3/2018 | Zhang et al. | |
| 2018/0163195 A1 | 6/2018 | Wong et al. | |
| 2018/0346589 A1 | 12/2018 | Ngo et al. | |
| 2019/0241954 A1 | 8/2019 | Doudna et al. | |
| 2020/0291382 A1* | 9/2020 | Zhang | C12N 9/78 |
| 2020/0308234 A1 | 10/2020 | Ngo et al. | |
| 2020/0377564 A1 | 12/2020 | Khalil et al. | |

FOREIGN PATENT DOCUMENTS

| | | |
|---|---|---|
| WO | 2015188191 A1 | 12/2015 |
| WO | 2018111838 A1 | 6/2018 |
| WO | 2018222880 A1 | 12/2018 |
| WO | 2019060746 A1 | 3/2019 |
| WO | 2019118518 A2 | 6/2019 |
| WO | 2019236982 A1 | 12/2019 |
| WO | 2020028729 A1 | 2/2020 |
| WO | 2020205510 A1 | 10/2020 |
| WO | 2020232366 A2 | 11/2020 |

OTHER PUBLICATIONS

Kawano et al., "Engineered pairs of distinct photoswitches for optogenetic control of cellular proteins", Nature Communications, 2015|6:6256|, pp. 1-8. DOI: 10.1038/ncomms7256.*
Nuñez et al., "Chemical and Biophysical Modulation of Cas9 for Tunable Genome Engineering", ACS Chemical Biology, 2016, vol. 11, pp. 681-688. DOI: 10.1021/acschembio.5b01019.*
Nihongaki et al., "Photoactivatable CRISPR-Cas9 for optogenetic genome editing". Nature Biotechnology, 2015, vol. 33, No. 7, pp. 755-760. doi:10.1038/nbt.3245.*
Zhang et al., "Two HEPN domains dictate CRISPR RNA maturation and target cleavage in Cas13d", Nature Communications, 2019 : |10:2544 |, pp. 1-11.*
Chang et al., "A Modular Receptor Platform to Expand the Sensing Repertoire of Bacteria", ACS Synthetic Biology, 2018, vol. 7, pp. 166-175. DOI: 10.1021/acssynbio.7b00266.*
Slaymaker et al., "High-resolution structure of Cas13b and biochemical characterization of RNA targeting and cleavage", Cell Rep., 2019, 26(13):3741-3751.e5. doi:10.1016/j.celrep.2019.02.094.*
Liu et al., "The Molecular Architecture for RNA-Guided RNA Cleavage by Cas13a", Cell, 2017, vol. 170, pp. 714-726.*
Abudayyeh et al. "C2c2 is a single-component programmable RNA-guided RNA-targeting CRISPR effector." Science 353(6299): 1-17 (2016).
Auslander et al. "Programmable single-cell mammalian biocomputers." Nature 487(7405): 123-127 (2012).
Banaszynski et al. "Characterization of the FKBP · Rapamycin · FRB ternary complex." Journal of the American Chemical Society 127(13): 4715-4721 (2005).
Bandaru et al. "Structure-based design of gRNAfor Cas13." Scientific reports 10(1): 1-12 (2020).
Berg et al. "Physiological functions of endosomal proteolysis." Biochemical Journal 307(2): 313-326 (1995).

(Continued)

*Primary Examiner* — Suzanne M Noakes
(74) *Attorney, Agent, or Firm* — Nixon Peabody LLP; Ronald I. Eisenstein; Nicole D. Kling

(57) ABSTRACT

The technology described herein is directed to inducible and repressible polypeptides and polypeptide systems. In particular, described herein are split sequence-specific nucleases and split recombinases that are linked to drug-inducible or drug-repressible dimerization domains. In some embodiments, the polypeptides comprise sequestering domains and/or have their expression controlled by an inducible promoter. In multiple aspects described herein are polynucleotides, vectors, cells, and pharmaceutical compositions comprising said polypeptides or polypeptide systems. Also described herein are methods of using said polypeptide systems to modulate the expression of a target polypeptide or to treat a subject in need of a cell therapy.

8 Claims, 54 Drawing Sheets

Specification includes a Sequence Listing.

(56) References Cited

OTHER PUBLICATIONS

Bonnet et al. "Amplifying genetic logic gates." Science 340(6132): 599-603 (2013).
Bojar et al. "Caffeine-inducible gene switches controlling experimental diabetes." Nature communications 9(1): 1-10 (2018).
Calos. "The φC31 Integrase System for Gene Therapy." Current gene therapy 6(6): 633-645 (2006).
Chakravarti et al. "Inducible gene switches with memory in human T cells for cellular immunotherapy." ACS synthetic biology 8(8): 1744-1754 (2019).
Chen et al. "CRISPR-Cas12a target binding unleashes indiscriminate single-stranded DNase activity." Science 360 (6387): 436-439 (2018).
Cox et al. "RNA editing with CRISPR-Cas13." Science 358(6366): 1019-1027 (2017).
Cunningham-Bryant et al., "A chemically-disrupted proximity system for controlling dynamic cellular processes." J Am Chem Soc. 141 (8): 3352-3355 (2019).
Daringer et al. "Modular extracellular sensor architecture for engineering mammalian cell-based devices." ACS synthetic biology 3(12): 892-902 (2014).
El-Mofty et al. "Carcinogenic effect of gibberellin A3 in Swiss albino mice." Nutr. Cancer 21 (2):183-190 (1994).
Feil et al. "Inducible cre mice." Gene knockout protocols, 530. Humana Press, 343-363 (2009).
Feil et al. "Regulation of Cre recombinase activity by mutated estrogen receptor ligand-binding domains." Biochemical and biophysical research communications 237(3): 752-757 (1997).
Felker et al. "In vivo performance and properties of tamoxifen metabolites for CreERT2 control." PloS ONE 11 (4): e0152989 (2016).
Foight et al. "Multi-input chemical control of protein dimerization for programming graded cellular responses." Nature biotechnology 37(10): 1209-1216 (2019).
Franco et al. "Production and characterization of a genetically engineered anti-caffeine camelid antibody and its use in immunoaffinity chromatography." Journal of Chromatography B 878(2): 177-186 (2010).
Gonda et al. "Universality and structure of the N-end rule." Journal of Biological Chemistry 264(28): 16700-16712 (1989).
Gros et al. "PD-1 identifies the patient-specific CD8+ tumor-reactive repertoire infiltrating human tumors." The Journal of clinical investigation 124(5): 2246-2259 (2014).
Gros et al. "Prospective identification of neoantigen-specific lymphocytes in the peripheral blood of melanoma patients." Nature medicine 22(4): 433-438 (2016).
Ham et al. "A tightly regulated inducible expression system utilizing the fim inversion recombination switch." Biotechnology and bioengineering 94(1): 1-4 (2006).
Ham et al. "Design and construction of a double inversion recombination switch for heritable sequential genetic memory." PloS ONE 3(7): 1-9 (2008).
Hao et al. "The molecular basis of ABA-independent inhibition of PP2Cs by a subclass of PYL proteins." Molecular cell 42(5): 662-672 (2011).
Harper et al. "Discovery of MK-5172, a macrocyclic hepatitis C virus NS3/4a protease inhibitor." ACS medicinal chemistry letters 3(4): 332-336 (2012).
Hill et al. "Human antibody-based chemically induced dimerizers for cell therapeutic applications." Nature chemical biology 14(2): 112-117(2018).
Hooper et al. "Membrane protein secretases." Biochemical Journal 321(2): 265-279 (1997).
Kang et al. "COMBINES-CID: An efficient method for de novo engineering of highly specific chemically induced protein dimerization systems." J Am Chem Soc. 141(28): 10948-10952 (2019).
Kennedy et al. "Rapid blue-light-mediated induction of protein interactions in living cells." Nature methods 7(12): 973-975 (2010).
Kim et al. "Mouse Cre-LoxP system: general principles to determine tissue-specific roles of target genes." Laboratory animal research 34(4): 147-159 (2018).
Kliemann et al. "Polymorphisms and resistance mutations of hepatitis C virus on sequences in the European hepatitis C virus database." World journal of gastroenterology 22(40): 8910-8917 (2016).
Konermann et al. "Transcriptome engineering with RNA-targeting type VI-D CRISPR effectors." Cell 173(3): 665-676 (2018).
Kugler et al. "High affinity peptide inhibitors of the hepatitis C virus NS3-4A protease refractory to common resistant mutants." Journal of Biological Chemistry 287(46): 39224-39232 (2012).
Lakso et al. "Targeted oncogene activation by site-specific recombination in transgenic mice." Proceedings of the National Academy of Sciences 89(14): 6232-6236 (1992).
Lesne et al. "Structural basis for chemically-induced homodimerization of a single domain antibody." Scientific reports 9(1): 1-4 (2019).
Li et al. "Screening for functional circular RNAs using the CRISPR-Cas13 system." BioRxiv, Mar. 25, 2020, available on the world wide web at https://www.biorxiv.org/content/10.1101/2020.03.23.002865v1.full.
Liang et al. "Engineering the ABA plant stress pathway for regulation of induced proximity." Science signaling 4(164): 1-18 (2011).
Lin. "HCV NS3-4A serine protease." Hepatitis C viruses: genomes and molecular biology 163-206 (2006).
Liu et al. "A chemical-inducible CRISPR-Cas9 system for rapid control of genome editing." Nature chemical biology 12(11): 980-987 (2016).
McCauley et al. "Hepatitis C virus NS3/4a protease inhibitors." Current opinion in pharmacology 30: 84-92 (2016).
McGowan et al. "PD-1 disrupted CAR-T cells in the treatment of solid tumors: Promises and challenges." Biomedicine & Pharmacotherapy 121(109625): 1-14 (2020).
Miyamoto et al. "Rapid and orthogonal logic gating with a gibberellin-induced dimerization system." Nature chemical biology 8(5): 465-470 (2012).
Morsut et al. "Engineering Customized Cell Sensing and Response Behaviors Using Synthetic Notch Receptors." Cell. 164(4): 780-91 (2016).
Murakami et al. "Degradation of proteins with blocked amino groups by cytoplasmic proteases." Biochemical and biophysical research communications 146(3): 1249-1255 (1987).
Odorizzi et al. "Genetic absence of PD-1 promotes accumulation of terminally differentiated exhausted CD8+ T cells." Journal of Experimental Medicine 212(7): 1125-1137 (2015).
Rupp et al. "CRISPR/Cas9-mediated PD-1 disruption enhances anti-tumor efficacy of human chimeric antigen YeceptorT cells." Scientific reports 7(1): 1-10(2017).
Santos et al. "Implementation of stable and complex biological systems through recombinase-assisted genome engineering." Nature communications 4(1): 1-10 (2013).
Schonhuber et al. "A next-generation dual-recombinase system for time and host specific targeting of pancreatic cancer." Nature medicine 20(11): 1340-1347 (2014).
Siuti et al. "Synthetic circuits integrating logic and memory in living cells." Nature biotechnology 31 (5): 448-452 (2013).
Smargon et al. "Cas13b is a type VI-B CRISPR-associated RNA-guided RNase differentially regulated by accessory proteins Csx27 and Csx28." Molecular cell 65(4): 618-630 (2017).
Smyth et al. "Granzymes: exogenous porteinases that induce target cell apoptosis." Immunology today 16(4): 202-206 (1995).
Sonneson et al. "Hapten-induced dimerization of a single-domain VHH camelid antibody." Biochemistry 48(29): 6693-6695 (2009).
Spencer et al. "Controlling signal transduction with synthetic ligands." Science 262(5136): 1019-1024 (1993).
Stanton et al. "Chemically induced proximity in biology and medicine." Science 359(6380): 1-15 (2018).
Sun et al. "Analysis of naturally occurring resistance-associated variants to NS3/4A protein inhibitors, NS5A protein inhibitors, and NS5B polymerase inhibitors in patients with chronic hepatitis C." Gene expression 18(1): 63-69 (2018).

(56) References Cited

OTHER PUBLICATIONS

Talanian et al. "Substrate specificities of caspase family proteases." Journal of Biological Chemistry 272(15): 9677-9682 (1997).

Thornberry et al. "A combinatorial approach defines specificities of members of the caspase family and granzyme B: functional relationships established for key mediators of apoptosis." Journal of Biological Chemistry 272(29): 17907-17911 (1997).

Ventura et al. "Restoration of p53 function leads to tumour regression in vivo." Nature 445(7128): 661-665 (2007).

Weinberg et al. "High-performance chemical- and light-inducible recombinases in mammalian cells and mice." Nature communications 10(1): 1-10 (2019).

Weinberg et al. "Large-scale design of robust genetic circuits with multiple inputs and outputs for mammalian cells." Nature biotechnology 35(5): 453-462 (2017).

Wolfsberg et al. "ADAM, a novel family of membrane proteins containing A Disintegrin and Metalloprotease domain: multipotential functions in cell-cell and cell-matrix interactions." The Journal of cell biology 131(2): 275-278 (1995).

Yan et al. "Cas13d is a compact RNA-targeting type VI CRISPR effector positively modulated by a WYL-domain-containing accessory protein." Molecular cell 70(2): 327-339 (2018).

Yang et al. "Transgenic tools for analysis of the haematopoietic system: knock-in CD45 reporter and deletor mice." Journal of immunological methods 337(2): 81-87 (2008).

Zetche et al. "A split-Cas9 architecture for inducible genome editing and transcription modulation." Nature biotechnology 33(2): 139-142 (2015).

Zhang et al. "Structural basis for the RNA-guided ribonuclease activity of CRISPR-Cas13d." Cell 175(1): 212-223 (2018).

Zhuang et al. "Targeted gene expression in dopamine and serotonin neurons of the mouse brain." Journal of neuroscience methods 143(1): 27-32 (2005).

Rafiq et al., "Engineering strategies to overcome the current roadblocks in CAR T cell therapy." Nature Reviews Clinical Oncology 17(3): 147-67 (2019).

Werb, "ECM and cell surface proteolysis: regulating cellular ecology." Cell 91: 439-442 (1997).

Wessels et al., "Massively parallel Cas13 screens reveal principles for guide RNA design." Nature Biotechnology 38 (6): 722-27 (2020).

\* cited by examiner

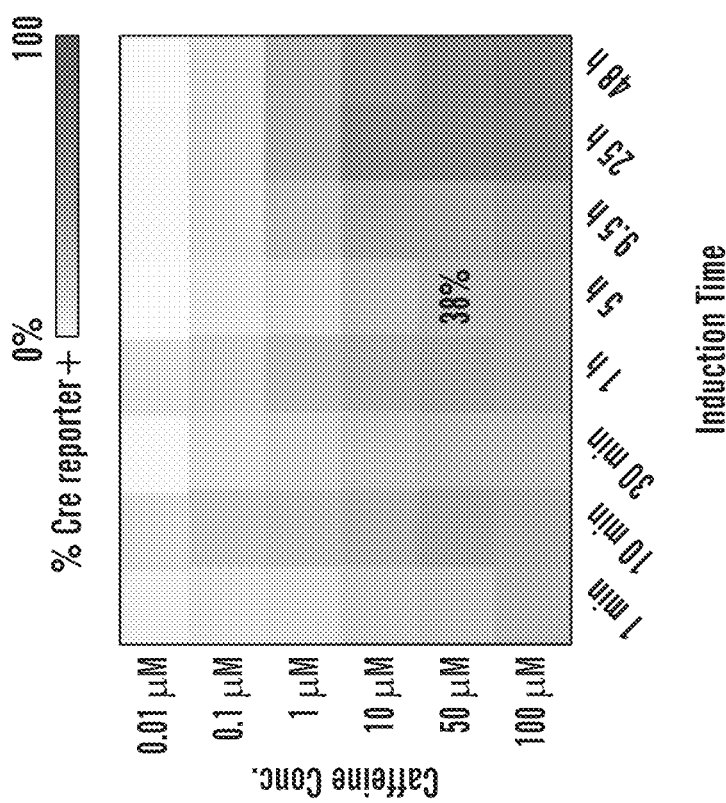
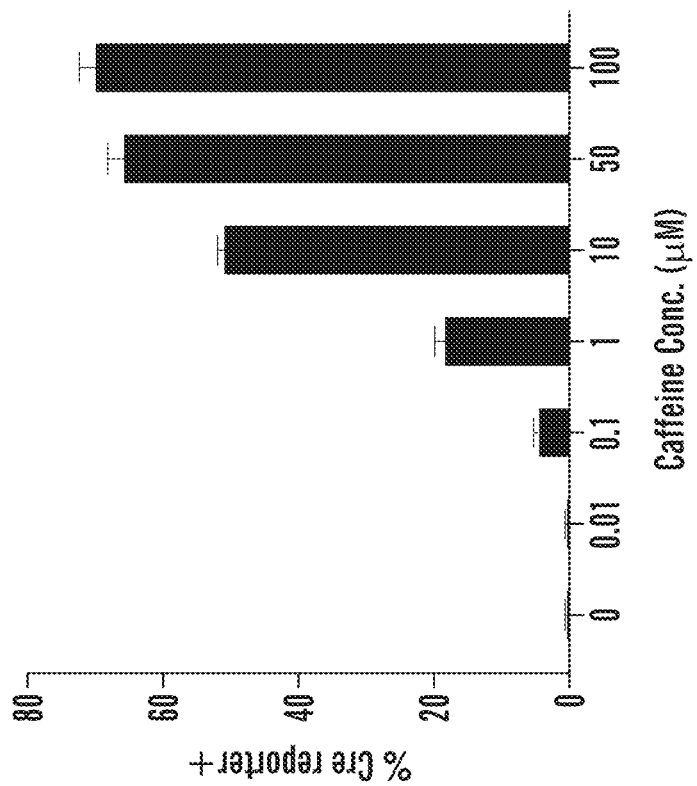
FIG. 1D
FIG. 1C

INDUCIBLE CONTROL OF GENE EXPRESSION

CROSS-REFERENCE TO RELATED APPLICATIONS

This application claims benefit under 35 U.S.C. § 119(e) of U.S. Provisional Application No. 63/054,446 filed Jul. 21, 2020, the contents of which are incorporated herein by reference in their entirety.

GOVERNMENT SUPPORT

This invention was made with government support under contracts No. CBET-1553356 and CCF-1522074 awarded by the National Science Foundation. The government has certain rights in the invention.

SEQUENCE LISTING

The instant application contains a Sequence Listing which has been submitted in ASCII format via EFS-Web and is hereby incorporated by reference in its entirety. Said ASCII copy, created on Jul. 20, 2021, is named 701586-098080US-PT_SL.txt and is 13,025,484 bytes in size.

TECHNICAL FIELD

The technology described herein relates to inducible control of gene expression.

BACKGROUND

Next generation cell therapies seek to create designer immune cells that can sense and respond to disease in sophisticated ways. Achieving this goal fundamentally requires engineered regulatory elements and circuitry that can be used to program human cell functions by processing complex environmental inputs and mediating precisely regulated expression of therapeutic agents. Towards this goal, synthetic transcriptional programs can interface with sense and response modules to permit new layers of regulation in cells.

To advance immune cell therapies beyond reliance on simple constitutive expression of therapeutic agents, there is a need for programmable genetic components that offer tunable and versatile regulatory profiles. Moreover, these components must themselves have properties that are compatible with the human therapeutic context, including high specificity, low immunogenicity, and deliverability.

T cell immunotherapy has shown tremendous promise for cancer treatment, including liquid tumors such as leukemia and lymphoma. However, alongside its remarkable effectiveness, there are significant side effects, such as cytokine releasing syndrome (CRS) and neurotoxicity, which pose life-threatening risks to patients receiving immunotherapy. It is increasingly important to develop safe and effective sense-and-response strategies that can control the activity of engineered T cells post-infusion.

SUMMARY

The technology described herein is directed to inducible and repressible polypeptides and polypeptide systems. In particular, described herein are split sequence-specific nucleases (e.g., Cas13d) and split recombinases (e.g., Cre) that are linked to drug-inducible or drug-repressible dimerization domains. In the absence of the drug, the two split halves of the sequence-specific nuclease or recombinase do not complement and are inactive. In the presence of the drug, the two split halves of the sequence-specific nuclease or recombinase come together to form an active protein. Such drugs include non-toxic, readily available, clinically approved molecules such as caffeine, grazoprevir, and danoprevir. The polypeptides can also comprise sequestering domains and/or have their expression controlled by an inducible promoter, which adds another layer of control to such gene expression systems. In multiple aspects described herein are polynucleotides, vectors, cells, and pharmaceutical compositions comprising said polypeptides or polypeptide systems. Also described herein are methods of using said polypeptide systems to modulate the expression of a target polypeptide or to treat a subject in need of a cell therapy.

In one aspect described herein is an inducible split-nuclease polypeptide system comprising: (a) a first polypeptide comprising: (i) a first member of an inducible dimerization domain ($D^1$); and (ii) a first polypeptide fragment of a sequence-specific nuclease ($N^1$); and (b) a second polypeptide comprising: (i) a second member of the inducible dimerization domain ($D^2$); and (ii) a second polypeptide fragment of the sequence-specific nuclease ($N^2$); and wherein the first and second members of the inducible dimerization domain come together in the presence of an inducer agent or inducer signal, resulting in protein complementation of the two nuclease polypeptide fragments to form the active nuclease protein in the presence of the inducer agent or inducer signal. In some embodiments of any of the aspects, there is virtually no lag time after the complementary pieces come together and the protein being in its active form. For example, 30 seconds or less, 25 seconds or less, 20 seconds or less, 15 seconds or less, 10 seconds or less, 5 seconds or less.

In one aspect described herein is an inducible split-recombinase polypeptide system comprising: (a) a first polypeptide comprising: (i) a first member of an inducible dimerization domain (D); and (ii) a first polypeptide fragment of a recombinase ($R^1$); and (b) a second polypeptide comprising: (i) a second member of the inducible dimerization domain ($D^2$); and (ii) a second polypeptide fragment of the recombinase ($R^2$); and wherein the first and second members of the inducible dimerization domain come together in the presence of an inducer agent or inducer signal, resulting in protein complementation of the two recombinase polypeptide fragments to form the active recombinase protein in the presence of the inducer agent or inducer signal. As discussed above, this can be with virtually no lag time in obtaining the active state.

In some embodiments of any of the aspects, the first ($D^1$) and second ($D^2$) members of the inducible dimerization domain comprise a caffeine-induced dimerization system.

In some embodiments of any of the aspects, $D^1$ and $D^2$ each comprise a VHH camelid antibody that specifically binds to caffeine (CaffVHH).

In some embodiments of any of the aspects, $D^1$ and $D^2$ each comprise a tandem VHH camelid antibody that specifically binds to caffeine (tandem CaffVHH).

In some embodiments of any of the aspects, one of $D^1$ or $D^2$ is encoded by a nucleic acid that is codon-optimized to prevent recombination.

In some embodiments of any of the aspects, $D^1$ and $D^2$ are selected from the group consisting of: (a) $D^1$ comprising a GID1 domain or a fragment thereof, and $D^2$ comprising a GAI domain, wherein the GID1 domain and GAI domain bind to the inducer agent Gibberellin Ester (GIB); (b) $D^2$ comprising a GID1 domain or a fragment thereof, and $D^1$ comprising a GAI domain, wherein the GID1 domain and GAI domain bind to the inducer agent Gibberellin Ester (GIB); (c) $D^1$ comprising a FKBP domain or a fragment thereof, and $D^2$ comprising a FRB domain, wherein the FKBP domain and FRB domain bind to the inducer agent Rapalog (RAP); (d) $D^2$ comprising a FKBP domain or a fragment thereof, and $D^1$ comprising a FRB domain, wherein the FKBP domain and FRB domain bind to the inducer agent Rapalog (RAP); (e) $D^1$ comprising a PYL domain or a fragment thereof, and $D^2$ comprising an ABI domain, wherein the PYL domain and ABI domain bind to the inducer agent Abscisic acid (ABA); (f) $D^2$ comprising a PYL domain or a fragment thereof, and $D^1$ comprising an ABI domain, wherein the PYL domain and ABI domain bind to the inducer agent Abscisic acid (ABA); (g) $D^1$ comprising a Light-inducible dimerization domain (LIDD), wherein a LIDD dimerizes with a complementary LIDD ($D^2$) upon exposure to a light inducer signal of an appropriate wavelength; and (h) $D^2$ comprising a Light-inducible dimerization domain (LIDD), wherein a LIDD dimerizes with a complementary LIDD ($D^1$) upon exposure to a light inducer signal of an appropriate wavelength.

In some embodiments of any of the aspects, the LIDD is nMag or CIBN or a photochromic protein domain, wherein nMag can dimerize with the complementary LIDD pMag upon exposure to a blue light inducer signal, and wherein CIBN can dimerize with the complementary CRY2 upon exposure to a blue inducer light signal, and wherein the photochromic proteins can dimerize upon exposure to a blue inducer light signal.

In some embodiments of any of the aspects, the light inducer signal is a pulse light signal.

In some embodiments of any of the aspects, (a) $D^1$ comprises a repressible protease and $D^2$ comprises a reader domain; or (b) $D^2$ comprises a repressible protease and $D^1$ comprises a reader domain; wherein the reader domain specifically binds to a repressible protease in the presence of a specific protease inhibitor.

In some embodiments of any of the aspects, the repressible protease is hepatitis C virus (HCV) nonstructural protein 3 (NS3).

In some embodiments of any of the aspects, the NS3 is catalytically dead.

In some embodiments of any of the aspects, the first or second polypeptide does not comprise any protease cleavage sites.

In some embodiments of any of the aspects, the system further comprises a cofactor for the repressible protease.

In some embodiments of any of the aspects, the cofactor is an HSV NS4A domain.

In some embodiments of any of the aspects, the HSV NS4A domain is adjacent and N-terminal to the repressible protease.

In some embodiments of any of the aspects, the reader domain is selected from the group consisting of: (a) a danoprevir/NS3 complex reader (DNCR) domain; and (b) a grazoprevir/NS3 reader complex (GNCR) domain.

In some embodiments of any of the aspects, the protease inhibitor is selected from grazoprevir, danoprevir, simeprevir, asunaprevir, ciluprevir, boceprevir, sovaprevir, paritaprevir, ombitasvir, paritaprevir, ritonavir, dasabuvir, and telaprevir.

In some embodiments of any of the aspects, the reader domain is DNCR and the protease inhibitor is danoprevir.

In some embodiments of any of the aspects, the reader domain is GNCR and the protease inhibitor is grazoprevir.

In one aspect described herein is a repressible split-nuclease polypeptide system comprising: (a) a first polypeptide comprising: (i) a first member of a repressible dimerization domain ($RD^1$); and (ii) a first polypeptide fragment of a sequence-specific nuclease ($N^1$); and (b) a second polypeptide comprising: (i) a second member of the repressible dimerization domain ($RD^2$); and (ii) a second polypeptide fragment of the sequence-specific nuclease ($N^2$); and wherein the first and second members of the repressible dimerization domain come together in the absence of a repressor agent or target signal, resulting in protein complementation of the two nuclease polypeptide fragments to form the active nuclease protein in the absence of the repressor agent or repressor signal; wherein the first and second members of the repressible dimerization domain do not come together in the presence of the repressor agent or repressor signal, resulting in no protein complementation of the two nuclease polypeptide fragments and no formation of the active nuclease protein in the presence of the repressor agent or repressor signal.

In one aspect described herein is a repressible split-recombinase polypeptide system comprising: (a) a first polypeptide comprising: (i) a first member of a repressible dimerization domain ($RD^1$); and (ii) a first polypeptide fragment of a recombinase ($R^1$); and (b) a second polypeptide comprising: (i) a second member of the repressible dimerization domain ($RD^2$); and (ii) a second polypeptide fragment of the recombinase ($R^2$); and wherein the first and second members of the repressible dimerization domain come together in the absence of a repressor agent or repressor signal, resulting in protein complementation of the two recombinase polypeptide fragments to form the active recombinase protein in the absence of the repressor agent or repressor signal; wherein the first and second members of the repressible dimerization domain do not come together in the presence of the repressor agent or repressor signal, resulting in no protein complementation of the two recombinase polypeptide fragments and no formation of the active recombinase protein in the presence of the repressor agent or repressor signal.

In some embodiments of any of the aspects, (a) $RD^1$ comprises a repressible protease and $RD^2$ comprises a peptide domain; or (b) $RD^2$ comprises a repressible protease and $RD^1$ comprises a peptide domain; wherein the repressible protease specifically binds to the peptide domain in the absence of a specific protease inhibitor.

In some embodiments of any of the aspects, the repressible protease does not specifically bind to the peptide domain in the presence of a specific protease inhibitor.

In some embodiments of any of the aspects, the repressible protease is hepatitis C virus (HCV) nonstructural protein 3 (NS3).

In some embodiments of any of the aspects, the NS3 is catalytically dead.

In some embodiments of any of the aspects, the polypeptide does not comprise any protease cleavage sites.

In some embodiments of any of the aspects, the system further comprises a cofactor for the repressible protease.

In some embodiments of any of the aspects, the cofactor is an HSV NS4A domain.

In some embodiments of any of the aspects, the HSV NS4A domain is adjacent and N-terminal to the repressible protease.

In some embodiments of any of the aspects, the peptide domain comprises ANR peptide SEQ ID NO: 170) or CP5-46-5D5E peptide (SEQ ID NO: 171).

In some embodiments of any of the aspects, the protease inhibitor is selected from grazoprevir, danoprevir, simeprevir, asunaprevir, ciluprevir, boceprevir, sovaprevir, paritaprevir, ombitasvir, paritaprevir, ritonavir, dasabuvir, and telaprevir.

In some embodiments of any of the aspects, the protease inhibitor is danoprevir or grazoprevir.

In one aspect described herein is an inducible nuclease split-recombinase polypeptide system comprising: (a) a first polypeptide comprising: (i) a first sequence-specific nuclease ($N^A$); and (ii) a first polypeptide fragment of a recombinase ($R^1$); and (b) a second polypeptide comprising: (i) a second sequence-specific nuclease ($N^B$); and (ii) a second polypeptide fragment of the recombinase ($R^2$); and wherein the first and second sequence-specific nucleases each specifically bind to first and second target nucleic acids in the presence of first and second guide nucleic acids, wherein the first and second target nucleic acids are in close proximity to each other, resulting in protein complementation of the two recombinase polypeptide fragments to form the active recombinase protein in the presence of the guide nucleic acids and first and second target nucleic acids.

In some embodiments of any of the aspects, $N^A$ and $N^B$ are comprised by different sequence-specific nucleases that each recognize their guide nucleic acid orthogonally.

In some embodiments of any of the aspects, the first and second target nucleic acids are comprised by the same nucleic acid molecule.

In some embodiments of any of the aspects, the first and second target nucleic acids are within 300 nucleotides of each other.

In one aspect described herein is an inducible split-nuclease split-recombinase polypeptide system comprising: (a) a first polypeptide comprising: (i) a first polypeptide fragment of a sequence-specific nuclease ($N^1$); and (ii) a first polypeptide fragment of a recombinase ($R^1$); and (b) a second polypeptide comprising: (i) a second polypeptide fragment of the sequence-specific nuclease ($N^2$); and (ii) a second polypeptide fragment of the recombinase ($R^2$); and wherein the first and second polypeptide fragments of the sequence specific nuclease come together in the presence of a guide nucleic acid and a nucleic acid targeted by the guide nucleic acid, resulting in protein complementation of the two recombinase polypeptide fragments to form the active recombinase protein in the presence of the guide nucleic acid and a target nucleic acid targeted by the guide nucleic acid.

In one aspect described herein is an inducible split-nuclease sequestering polypeptide system comprising: (a) a first polypeptide comprising a first polypeptide fragment of a sequence-specific nuclease ($N^1$); and (b) a second polypeptide comprising a second polypeptide fragment of the sequence-specific nuclease ($N^2$); and wherein the first and/or second polypeptide comprises a cytosolic sequestering domain comprising a ligand binding domain (LBD), wherein, in the presence of a ligand, the sequestering of the protein to the cytosol is inhibited; wherein the first and/or second polypeptides are transported to the nucleus in the presence of the ligand, resulting in protein complementation of the two nuclease polypeptide fragments to form the active nuclease protein in the presence of the ligand.

In one aspect described herein is an inducible split-recombinase sequestering polypeptide system comprising: (a) a first polypeptide comprising a first polypeptide fragment of a recombinase ($R^1$); and (b) a second polypeptide comprising a second polypeptide fragment of the recombinase ($R^2$); and wherein the first and/or second polypeptide comprises a cytosolic sequestering domain comprising a ligand binding domain (LBD), wherein, in the presence of a ligand, the sequestering of the protein to the cytosol is inhibited; wherein the first and/or second polypeptides are transported to the nucleus in the presence of the ligand, resulting in protein complementation of the two recombinase polypeptide fragments to form the active recombinase protein in the presence of the ligand.

In one aspect described herein is an inducible nuclear split-nuclease polypeptide system comprising: (a) a first polypeptide comprising: (i) a first polypeptide fragment of a sequence-specific nuclease ($N^1$); and (ii) a nuclear localization signal (NLS); and (b) a second polypeptide comprising: (i) a second polypeptide fragment of the sequence-specific nuclease ($N^2$); and (ii) a nuclear localization signal (NLS); wherein the first and second polypeptides come together in the nucleus in the presence of a guide nucleic acid, resulting in protein complementation of the two nuclease polypeptide fragments to form the active nuclease protein in the presence of the guide nucleic acid.

In one aspect described herein is an inducible cytoplasmic split-nuclease polypeptide system comprising: (a) a first polypeptide comprising: (i) a first polypeptide fragment of a sequence-specific nuclease ($N^1$); and (ii) a nuclear export signal (NES); and (b) a second polypeptide comprising: (i) a second polypeptide fragment of the sequence-specific nuclease ($N^2$); and (ii) a nuclear export signal (NES); wherein the first and second polypeptides come together in the cytoplasm in the presence of a guide nucleic acid, resulting in protein complementation of the two nuclease polypeptide fragments to form the active nuclease protein in the presence of the guide nucleic acid.

In some embodiments of any of the aspects, the sequence-specific nuclease is a Cas endonuclease.

In some embodiments of any of the aspects, the Cas endonuclease is Cas13 endonuclease.

In some embodiments of any of the aspects, the Cas13 endonuclease is Cas13a, Cas13b, or Cas13d.

In some embodiments of any of the aspects, the Cas endonuclease is in combination with a guide nucleic acid that specifically binds to a target nucleic acid.

In some embodiments of any of the aspects, the Cas endonuclease exhibits collateral cleavage of non-guide nucleic acids.

In some embodiments of any of the aspects, the Cas endonuclease can process pre-guide nucleic arrays to produce multiple guide nucleic acids each targeting a different target nucleic acid.

In some embodiments of any of the aspects, the target nucleic acid is a circular nucleic acid.

In some embodiments of any of the aspects, the Cas endonuclease is Cas13d.

In some embodiments of any of the aspects, the Cas endonuclease is RfxCas13d.

In some embodiments of any of the aspects, the Cas13d comprises the sequence of SEQ ID NO: 1 or a sequence that is at least 85% identical to SEQ ID NO: 1 that maintains the same function.

In some embodiments of any of the aspects, the first ($N^1$) and second ($N^2$) nuclease polypeptide fragments are Cas13d endonuclease polypeptide fragments, wherein $N^1$ and $N^2$ are selected from the group consisting of: (a) $N^1$ comprises a N-terminal polypeptide fragment of SEQ ID NO: 1 with the C-terminus ending at amino acid 88 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 89 of SEQ ID NO: 1 or a polypeptide that is at least 85% identical to SEQ ID NO: 1; (b) $N^1$ comprises a N-terminal polypeptide fragment of SEQ ID NO: 1 with the C-terminus ending at amino acid 263 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 264 of SEQ ID NO: 1 or a polypeptide that is at least 85% identical to SEQ ID NO: 1; (c) $N^1$ comprises a N-terminal polypeptide fragment of SEQ ID NO: 1 with the C-terminus ending at amino acid 384 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 385 of SEQ ID NO: 1 or a polypeptide that is at least 85% identical to SEQ ID NO: 1; (d) $N^1$ comprises a N-terminal polypeptide fragment of SEQ ID NO: 1 with the C-terminus ending at amino acid 404 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 405 of SEQ ID NO: 1 or a polypeptide that is at least 85% identical to SEQ ID NO: 1; (e) $N^1$ comprises a N-terminal polypeptide fragment of SEQ ID NO: 1 with the C-terminus ending at amino acid 507 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 508 of SEQ ID NO: 1 or a polypeptide that is at least 85% identical to SEQ ID NO: 1; (f) $N^1$ comprises a N-terminal polypeptide fragment of SEQ ID NO: 1 with the C-terminus ending at amino acid 559 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 560 of SEQ ID NO: 1 or a polypeptide that is at least 85% identical to SEQ ID NO: 1; (g) $N^1$ comprises a N-terminal polypeptide fragment of SEQ ID NO: 1 with the C-terminus ending at amino acid 565 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 566 of SEQ ID NO: 1 or a polypeptide that is at least 85% identical to SEQ ID NO: 1; (h) $N^1$ comprises a N-terminal polypeptide fragment of SEQ ID NO: 1 with the C-terminus ending at amino acid 576 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 577 of SEQ ID NO: 1 or a polypeptide that is at least 85% identical to SEQ ID NO: 1; (i) $N^1$ comprises a N-terminal polypeptide fragment of SEQ ID NO: 1 with the C-terminus ending at amino acid 655 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 656 of SEQ ID NO: 1 or a polypeptide that is at least 85% identical to SEQ ID NO: 1; and (j) $N^1$ comprises a N-terminal polypeptide fragment of SEQ ID NO: 1 with the C-terminus ending at amino acid 903 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 904 of SEQ ID NO: 1 or a polypeptide that is at least 85% identical to SEQ ID NO: 1.

In some embodiments of any of the aspects, the Cas endonuclease is Cas13a.

In some embodiments of any of the aspects, the Cas13a comprises the sequence of SEQ ID NO: 2 or a sequence that is at least 85% identical to SEQ ID NO: 2 that maintains the same function.

In some embodiments of any of the aspects, the first ($N^1$) and second ($N^2$) nuclease polypeptide fragments are Cas13a endonuclease polypeptide fragments, wherein $N^1$ and $N^2$ are selected from the group consisting of: (a) $N^1$ comprises a N-terminal polypeptide fragment of SEQ ID NO: 2 with the C-terminus ending at amino acid 416 of SEQ ID NO: 2 or a polypeptide that is at least 85% identical to SEQ ID NO: 2, and $N^2$ comprises a C-terminal polypeptide fragment of SEQ ID NO: 2 with the N-terminus beginning at amino acid 417 of SEQ ID NO: 2 or a polypeptide that is at least 85% identical to SEQ ID NO: 2; and (b) $N^1$ comprises a N-terminal polypeptide fragment of SEQ ID NO: 2 with the C-terminus ending at amino acid 421 of SEQ ID NO: 2 or a polypeptide that is at least 85% identical to SEQ ID NO: 2, and $N^2$ comprises a C-terminal polypeptide fragment of SEQ ID NO: 2 with the N-terminus beginning at amino acid 422 of SEQ ID NO: 2 or a polypeptide that is at least 85% identical to SEQ ID NO: 2.

In some embodiments of any of the aspects, the Cas endonuclease is Cas13b.

In some embodiments of any of the aspects, the Cas13b comprises the sequence of SEQ ID NO: 3 or a sequence that is at least 85% identical to SEQ ID NO: 3 that maintains the same function.

In some embodiments of any of the aspects, the first ($N^1$) and second ($N^2$) nuclease polypeptide fragments are Cas13b endonuclease polypeptide fragments, wherein $N^1$ and $N^2$ are selected from the group consisting of: (a) $N^1$ comprises a N-terminal polypeptide fragment of SEQ ID NO: 3 with the C-terminus ending at amino acid 49 of SEQ ID NO: 3 or a polypeptide that is at least 85% identical to SEQ ID NO: 3, and $N^2$ comprises a C-terminal polypeptide fragment of SEQ ID NO: 3 with the N-terminus beginning at amino acid 50 of SEQ ID NO: 3 or a polypeptide that is at least 85% identical to SEQ ID NO: 3; (b) $N^1$ comprises a N-terminal polypeptide fragment of SEQ ID NO: 3 with the C-terminus ending at amino acid 177 of SEQ ID NO: 3 or a polypeptide that is at least 85% identical to SEQ ID NO: 3, and $N^2$ comprises a C-terminal polypeptide fragment of SEQ ID NO: 3 with the N-terminus beginning at amino acid 178 of SEQ ID NO: 3 or a polypeptide that is at least 85% identical to SEQ ID NO: 3; (c) $N^1$ comprises a N-terminal polypeptide fragment of SEQ ID NO: 3 with the C-terminus ending at amino acid 250 of SEQ ID NO: 3 or a polypeptide that is at least 85% identical to SEQ ID NO: 3, and $N^2$ comprises a C-terminal polypeptide fragment of SEQ ID NO: 3 with the N-terminus beginning at amino acid 251 of SEQ ID NO: 3 or a polypeptide that is at least 85% identical to SEQ ID NO: 3; (d) $N^1$ comprises a N-terminal polypeptide fragment of SEQ ID NO: 3 with the C-terminus ending at amino acid 431 of SEQ ID NO: 3 or a polypeptide that is at least 85% identical to SEQ ID NO: 3, and $N^2$ comprises a C-terminal polypeptide fragment of SEQ ID NO: 3 with the N-terminus beginning at amino acid 432 of SEQ ID NO: 3 or a polypeptide that is at least 85% identical to SEQ ID NO: 3; and (e) $N^1$ comprises a N-terminal polypeptide fragment of SEQ ID NO: 3 with the C-terminus ending at amino acid 1065 of SEQ ID NO: 3 or a polypeptide that is at least 85% identical to SEQ ID NO: 3, and $N^2$ comprises a C-terminal polypeptide fragment of SEQ ID NO: 3 with the N-terminus beginning at amino acid 1066 of SEQ ID NO: 3 or a polypeptide that is at least 85% identical to SEQ ID NO: 3.

In some embodiments of any of the aspects, the recombinase is selected from the group consisting of Cre, Flp, PhiC, and vCre recombinases.

In some embodiments of any of the aspects, the recombinase is a Cre recombinase.

In some embodiments of any of the aspects, the Cre recombinase comprises the sequence of SEQ ID NO: 58 or a sequence that is at least 85% identical to SEQ ID NO: 58 that maintains the same function.

In some embodiments of any of the aspects, the first ($R^1$) and second ($R^2$) recombinase polypeptide fragments are Cre recombinase polypeptide fragments, wherein $R^1$ and $R^2$ are selected from the group consisting of: (a) $R^1$ comprises a N-terminal polypeptide fragment of SEQ ID NO: 1 with the C-terminus ending at amino acid 229 of SEQ ID NO: 58 or a polypeptide that is at least 85% identical to SEQ ID NO: 58, and $R^2$ comprises a C-terminal polypeptide fragment of SEQ ID NO: 1 with the N-terminus beginning at amino acid 230 of SEQ ID NO: 58 or a polypeptide that is at least 85% identical to SEQ ID NO: 58; (b) $R^1$ comprises a N-terminal polypeptide fragment of SEQ ID NO: 1 with the C-terminus ending at amino acid 251 of SEQ ID NO: 58 or a polypeptide that is at least 85% identical to SEQ ID NO: 58, and $R^2$ comprises a C-terminal polypeptide fragment of SEQ ID NO: 1 with the N-terminus beginning at amino acid 252 of SEQ ID NO: 58 or a polypeptide that is at least 85% identical to SEQ ID NO: 58; (c) $R^1$ comprises a N-terminal polypeptide fragment of SEQ ID NO: 1 with the C-terminus ending at amino acid 256 of SEQ ID NO: 58 or a polypeptide that is at least 85% identical to SEQ ID NO: 58, and $R^2$ comprises a C-terminal polypeptide fragment of SEQ ID NO: 58 with the N-terminus beginning at amino acid 257 of SEQ ID NO: 58 or a polypeptide that is at least 85% identical to SEQ ID NO: 58; and (d) $R^1$ comprises a N-terminal polypeptide fragment of SEQ ID NO: 1 with the C-terminus ending at amino acid 270 of SEQ ID NO: 58 or a polypeptide that is at least 85% identical to SEQ ID NO: 58, and $R^2$ comprises a C-terminal polypeptide fragment of SEQ ID NO: 1 with the N-terminus beginning at amino acid 271 of SEQ ID NO: 58 or a polypeptide that is at least 85% identical to SEQ ID NO: 58.

In some embodiments of any of the aspects, the recombinase is a Flp recombinase.

In some embodiments of any of the aspects, the Flp recombinase comprises the sequence of SEQ ID NO: 60 or a sequence that is at least 85% identical to SEQ ID NO: 60 that maintains the same function.

In some embodiments of any of the aspects, the first ($R^1$) and second ($R^2$) recombinase polypeptide fragments are Flp recombinase polypeptide fragments, wherein $R^1$ and $R^2$ are selected from the group consisting of: (a) $R^1$ comprises a N-terminal polypeptide fragment of SEQ ID NO: 60 with the C-terminus ending at amino acid 27 of SEQ ID NO: 60 or a polypeptide that is at least 85% identical to SEQ ID NO: 60, and $R^2$ comprises a C-terminal polypeptide fragment of SEQ ID NO: 60 with the N-terminus beginning at amino acid 28 of SEQ ID NO: 60 or a polypeptide that is at least 85% identical to SEQ ID NO: 60; (b) $R^1$ comprises a N-terminal polypeptide fragment of SEQ ID NO: 60 with the C-terminus ending at amino acid 168 of SEQ ID NO: 60 or a polypeptide that is at least 85% identical to SEQ ID NO: 60, and $R^2$ comprises a C-terminal polypeptide fragment of SEQ ID NO: 60 with the N-terminus beginning at amino acid 169 of SEQ ID NO: 60 or a polypeptide that is at least 85% identical to SEQ ID NO: 60; (c) $R^1$ comprises a N-terminal polypeptide fragment of SEQ ID NO: 60 with the C-terminus ending at amino acid 374 of SEQ ID NO: 60 or a polypeptide that is at least 85% identical to SEQ ID NO: 60, and $R^2$ comprises a C-terminal polypeptide fragment of SEQ ID NO: 60 with the N-terminus beginning at amino acid 375 of SEQ ID NO: 60 or a polypeptide that is at least 85% identical to SEQ ID NO: 60; and (d) $R^1$ comprises a N-terminal polypeptide fragment of SEQ ID NO: 60 with the C-terminus ending at amino acid 396 of SEQ ID NO: 60 or a polypeptide that is at least 85% identical to SEQ ID NO: 60, and $R^2$ comprises a C-terminal polypeptide fragment of SEQ ID NO: 60 with the N-terminus beginning at amino acid 397 of SEQ ID NO: 60 or a polypeptide that is at least 85% identical to SEQ ID NO: 60.

In some embodiments of any of the aspects, the recombinase is a PhiC recombinase.

In some embodiments of any of the aspects, the PhiC recombinase comprises the sequence of SEQ ID NO: 62 or a sequence that is at least 85% identical to SEQ ID NO: 62 that maintains the same function.

In some embodiments of any of the aspects, the first ($R^1$) and second ($R^2$) recombinase polypeptide fragments are PhiC recombinase polypeptide fragments, wherein $R^1$ and $R^2$ are selected from the group consisting of: (a) $R^1$ comprises a N-terminal polypeptide fragment of SEQ ID NO: 62 with the C-terminus ending at amino acid 233 of SEQ ID NO: 62 or a polypeptide that is at least 85% identical to SEQ ID NO: 62, and $R^2$ comprises a C-terminal polypeptide fragment of SEQ ID NO: 62 with the N-terminus beginning at amino acid 234 of SEQ ID NO: 62 or a polypeptide that is at least 85% identical to SEQ ID NO: 62; (b) $R^1$ comprises a N-terminal polypeptide fragment of SEQ ID NO: 62 with the C-terminus ending at amino acid 396 of SEQ ID NO: 62 or a polypeptide that is at least 85% identical to SEQ ID NO: 62, and $R^2$ comprises a C-terminal polypeptide fragment of SEQ ID NO: 62 with the N-terminus beginning at amino acid 397 of SEQ ID NO: 62 or a polypeptide that is at least 85% identical to SEQ ID NO: 62; (c) $R^1$ comprises a N-terminal polypeptide fragment of SEQ ID NO: 62 with the C-terminus ending at amino acid 428 of SEQ ID NO: 62 or a polypeptide that is at least 85% identical to SEQ ID NO: 62, and $R^2$ comprises a C-terminal polypeptide fragment of SEQ ID NO: 62 with the N-terminus beginning at amino acid 429 of SEQ ID NO: 62 or a polypeptide that is at least 85% identical to SEQ ID NO: 62; and (d) $R^1$ comprises a N-terminal polypeptide fragment of SEQ ID NO: 62 with the C-terminus ending at amino acid 571 of SEQ ID NO: 62 or a polypeptide that is at least 85% identical to SEQ ID NO: 62, and $R^2$ comprises a C-terminal polypeptide fragment of SEQ ID NO: 62 with the N-terminus beginning at amino acid 572 of SEQ ID NO: 62 or a polypeptide that is at least 85% identical to SEQ ID NO: 62.

In some embodiments of any of the aspects, the recombinase is a vCre recombinase.

In some embodiments of any of the aspects, the vCre recombinase comprises the sequence of SEQ ID NO: 65 or a sequence that is at least 85% identical to SEQ ID NO: 65 that maintains the same function.

In some embodiments of any of the aspects, the first ($R^1$) and second ($R^2$) recombinase polypeptide fragments are vCre recombinase polypeptide fragments, wherein $R^1$ and $R^2$ are selected from the group consisting of: (a) $R^1$ comprises a N-terminal polypeptide fragment of SEQ ID NO: 65 with the C-terminus ending at amino acid 82 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 83 of SEQ ID NO: 65 or a polypeptide that is at least 85% identical to SEQ ID NO: 65; (b) $R^1$ comprises a N-terminal polypeptide fragment of SEQ ID NO: 65 with the C-terminus ending at amino acid 172 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 173 of SEQ ID NO: 65 or a polypeptide that is at least 85% identical to SEQ ID NO: 65; (c) $R^1$ comprises a N-terminal polypeptide fragment of SEQ ID NO: 65 with the C-terminus ending at amino acid 210 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 211 of SEQ ID NO: 65 or a polypeptide that is at least 85% identical to SEQ ID NO: 65; (d) $R^1$ comprises a N-terminal polypeptide fragment of SEQ ID NO: 65 with the C-terminus ending at amino acid 269 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 270 of SEQ ID NO: 65 or a polypeptide that is at least 85% identical to SEQ ID NO: 65; and (e) $R^1$ comprises a N-terminal polypeptide fragment of SEQ ID NO: 65 with the C-terminus ending at amino acid 277 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 278 SEQ ID NO: 65 or a polypeptide that is at least 85% identical to SEQ ID NO: 65.

In some embodiments of any of the aspects, the first and/or second polypeptide further comprises at least one cytosolic sequestering domain.

In some embodiments of any of the aspects, cytosolic sequestering domain comprises a ligand binding domain (LBD), wherein, in the presence of a ligand, the sequestering of the protein to the cytosol is inhibited.

In some embodiments of any of the aspects, the cytosolic sequestering domain comprises a ligand binding domain (LBD) and a nuclear localization signal (NLS), wherein, in the absence of the ligand, the NLS is inhibited thereby preventing translocation of the sequestering protein to the nucleus, and wherein, in the presence of the ligand, the nuclear localization signal is exposed permitting translocation of the polypeptide to the nucleus.

In some embodiments of any of the aspects, the first and/or second polypeptide further comprises at least a portion of the estrogen receptor (ER).

In some embodiments of any of the aspects, the cytosolic sequestering domain comprises an estrogen ligand binding domain (ERT) or a variant thereof, selected from the group consisting of: ERT2, ERT, and ERT3.

In some embodiments of any of the aspects, the ERT binds to one or more ligands selected from: tamoxifen, 4-hydroxytamoxifen (4OHT), endoxifen, Fulvestrant, wherein binding of the ligand to ERT exposes the NLS and results in nuclear translocation of the ERT.

In some embodiments of any of the aspects, the cytosolic sequestering domain comprises a transmembrane sequestering domain.

In some embodiments of any of the aspects, the transmembrane sequestering domain comprises SynNotch.

In some embodiments of any of the aspects, the first polypeptide or second polypeptide further comprises at least one nuclear export signal (NES).

In some embodiments of any of the aspects, the first polypeptide or second polypeptide further comprises at least two nuclear export signals (NES).

In some embodiments of any of the aspects, the NES comprises HIV-1 Rev NES (LPPLERLTL, SEQ ID NO: 192) or focal adhesion kinase NES (LDLASLIL, SEQ ID NO: 2168).

In some embodiments of any of the aspects, the first polypeptide or second polypeptide further comprises at least one nuclear localization signal (NLS).

In some embodiments of any of the aspects, the first polypeptide or second polypeptide further comprises at least two nuclear localization signals (NLS).

In some embodiments of any of the aspects, the NLS comprises simian virus 40 (SV40) NLS (PKKKRKV, SEQ ID NO: 193) or nucleoplasmin (NPM2) NLS (KR-VAPQKQMSIAKKKKV, SEQ ID NO: 194).

In some embodiments of any of the aspects, the first polypeptide and second polypeptide are physically linked to one another.

In some embodiments of any of the aspects, the first polypeptide and second polypeptide flank a self-cleaving peptide domain.

In one aspect described herein is a polynucleotide encoding a first polypeptide, second polypeptide, or system as described.

In some embodiments of any of the aspects, the first polypeptide, second polypeptide, or system is operatively linked to a promoter.

In some embodiments of any of the aspects, the promoter is a constitutive promoter.

In some embodiments of any of the aspects, the constitutive promoter is a CAG promoter.

In some embodiments of any of the aspects, the promoter is an inducible promoter.

In one aspect described herein is a polynucleotide system comprising: (a) a first polynucleotide encoding for a first polypeptide as described herein; and (b) a second polynucleotide encoding for a second polypeptide as described herein; wherein the first and/or second polynucleotide is operatively linked to an inducible promoter.

In some embodiments of any of the aspects, the inducible promoter is induced by PMA, TGFβ, TNFa, or WNT.

In some embodiments of any of the aspects, the inducible promoter is selected from the group consisting of pAP1, pNFkB, pCAGA12, and pSTF.

In some embodiments of any of the aspects, the inducible promoter is a doxycycline inducible promoter.

In one aspect described herein is a vector comprising a polynucleotide as described herein.

In some embodiments of any of the aspects, the vector is a viral vector.

In one aspect described herein is a cell or population thereof comprising a polypeptide or system as described herein, a polynucleotide as described herein, or a vector as described herein.

In some embodiments of any of the aspects, the cell comprises an immune cell.

In some embodiments of any of the aspects, the immune cell comprises a CD4+ T cell, a CD8+ T cell, a regulatory T cell (Treg), or a natural killer (NK) cell.

In one aspect described herein is a pharmaceutical composition comprising a polypeptide or system as described herein, a polynucleotide as described herein, a vector as described herein, or a cell as described herein, and a pharmaceutically acceptable carrier.

In one aspect described herein is a kit comprising a polypeptide or system as described herein, a polynucleotide as described herein, a vector as described herein, a cell as described herein, or a pharmaceutical composition as described herein.

In some embodiments of any of the aspects, the polynucleotide as described herein, the vector as described herein, the cell as described herein, the pharmaceutical composition as described herein, or the kit as described herein, further comprises an inducer agent, repressor agent, guide nucleic acid, ligand for a sequestering domain, or ligand for an inducible promoter.

In one aspect described herein is a method of modulating the expression of a target polypeptide, comprising: (a) providing a population of cells comprising a polypeptide system as described herein; and (b) contacting the cells with the inducer agent or inducer signal for the inducible dimerization domain of the polypeptide system.

In some embodiments of any of the aspects, the method further comprises contacting the cells with a target nucleic acid encoding the target polypeptide, wherein the target nucleic acid comprises recombination sites specifically bound and cleaved by the active recombinase of the polypeptide system.

In some embodiments of any of the aspects, the method further comprises contacting the cells with a target nucleic acid encoding the target polypeptide, wherein the target nucleic acid comprises sites specifically bound and cleaved by the active sequence-specific nuclease of the polypeptide system.

In some embodiments of any of the aspects, the method further comprises contacting the cells with a guide nucleic acid for the active sequence-specific nuclease.

In one aspect described herein is a method of treating a subject in need of a cell-based therapy, comprising: (a) administering to the subject a population of cells comprising a polypeptide system as described herein; and (b) administering to the subject an effective amount of an inducer agent or inducer signal for the inducible dimerization domain.

In some embodiments of any of the aspects, the method further comprises administering a target nucleic acid encoding the target polypeptide, wherein the target nucleic acid comprises recombination sites specifically bound and cleaved by the active recombinase of the polypeptide system.

In some embodiments of any of the aspects, the method further comprises administering a target nucleic acid encoding the target polypeptide, wherein the target nucleic acid comprises sites specifically bound and cleaved by the active sequence-specific nuclease of the polypeptide system.

In some embodiments of any of the aspects, the method further comprises administering a guide nucleic acid for the active sequence-specific nuclease.

In some embodiments of any of the aspects, in the presence of the inducer agent or inducer signal for the inducible dimerization domain, the recombinase or sequence-specific nuclease is active.

In some embodiments of any of the aspects, in the absence of the inducer agent or inducer signal for the inducible dimerization domain, the recombinase or sequence-specific nuclease is inactive.

In some embodiments of any of the aspects, the expression of the target polypeptide is increased when the active recombinase or active sequence-specific nuclease cleaves a portion of the target polynucleotide that inhibits expression of the target polypeptide.

In some embodiments of any of the aspects, the expression of the target polypeptide is decreased when the active recombinase or active sequence-specific nuclease cleaves a portion of the target polynucleotide that induces expression of the target polypeptide or a portion of the target polynucleotide that encodes for the target polypeptide.

In one aspect described herein is a method of modulating the expression of a target polypeptide, comprising: (a) providing a population of cells comprising a polypeptide system as described herein; and (b) contacting the cells with a repressor agent or repressor signal for the repressible dimerization domain of the polypeptide system.

In some embodiments of any of the aspects, the method further comprises contacting the cells with a target nucleic acid encoding the target polypeptide, wherein the target nucleic acid comprises recombination sites specifically bound and cleaved by the active recombinase of the polypeptide system.

In some embodiments of any of the aspects, the method further comprises contacting the cells with a target nucleic acid encoding the target polypeptide, wherein the target nucleic acid comprises sites specifically bound and cleaved by the active sequence-specific nuclease of the polypeptide system.

In some embodiments of any of the aspects, the method further comprises contacting the cells with a guide nucleic acid for the active sequence-specific nuclease.

In one aspect described herein is a method of treating a subject in need of a cell-based therapy, comprising: (a) administering to the subject a population of cells comprising a polypeptide system as described herein; and (b) administering to the subject an effective amount of the repressor agent or repressor signal for the repressible dimerization domain.

In some embodiments of any of the aspects, the method further comprises administering a target nucleic acid encoding the target polypeptide, wherein the target nucleic acid comprises recombination sites specifically bound and cleaved by the active recombinase of the polypeptide system.

In some embodiments of any of the aspects, the method further comprises administering a target nucleic acid encoding the target polypeptide, wherein the target nucleic acid comprises sites specifically bound and cleaved by the active sequence-specific nuclease of the polypeptide system.

In some embodiments of any of the aspects, the method further comprises administering a guide nucleic acid for the active sequence-specific nuclease.

In some embodiments of any of the aspects, in the presence of the repressor agent or repressor signal for the repressible dimerization domain, the recombinase or sequence-specific nuclease is inactive.

In some embodiments of any of the aspects, in the absence of the repressor agent or repressor signal for the repressible dimerization domain, the recombinase or sequence-specific nuclease is active.

In some embodiments of any of the aspects, the expression of the target polypeptide is increased when the active recombinase or active sequence-specific nuclease cleaves a portion of the target polynucleotide that inhibits expression of the target polypeptide.

In some embodiments of any of the aspects, the expression of the target polypeptide is decreased when the active recombinase or active sequence-specific nuclease cleaves a portion of the target polynucleotide that induces expression of the target polypeptide or a portion of the target polynucleotide that encodes for the target polypeptide.

In one aspect described herein is a method of modulating the expression of a target polypeptide, comprising: (a) providing a population of cells comprising a polypeptide system as described herein; and (b) contacting the cells with the guide nucleic acids for the sequence-specific nucleases of the polypeptide system.

In some embodiments of any of the aspects, the method further comprises contacting the cells with the first and second target nucleic acids for the sequence-specific nucleases of the polypeptide system.

In some embodiments of any of the aspects, the method further comprises contacting the cells with a third target nucleic acid encoding the target polypeptide, wherein the target nucleic acid comprises recombination sites specifically bound and cleaved by the active recombinase of the polypeptide system.

In one aspect described herein is a method of treating a subject in need of a cell-based therapy, comprising: (a) administering to the subject a population of cells comprising a polypeptide system as described herein; and (b) administering to the subject an effective amount of the guide nucleic acids for the sequence-specific nucleases of the polypeptide system.

In some embodiments of any of the aspects, the method further comprises administering the first and second target nucleic acids for the sequence-specific nucleases of the polypeptide system.

In some embodiments of any of the aspects, the method further comprises administering a third target nucleic acid encoding the target polypeptide, wherein the target nucleic acid comprises recombination sites specifically bound and cleaved by the active recombinase of the polypeptide system.

In some embodiments of any of the aspects, in the presence of the guide nucleic acids and first and second target nucleic acids, the recombinase is active.

In some embodiments of any of the aspects, in the absence of the guide nucleic acids or first and second target nucleic acids, the recombinase is inactive.

In some embodiments of any of the aspects, the expression of the target polypeptide is increased when the active recombinase cleaves a portion of the target polynucleotide that inhibits expression of the target polypeptide.

In some embodiments of any of the aspects, the expression of the target polypeptide is decreased when the active recombinase cleaves a portion of the target polynucleotide that induces expression of the target polypeptide or a portion of the target polynucleotide that encodes for the target polypeptide.

In one aspect described herein is a method of detecting a target nucleic acid, comprising: (a) providing a population of cells comprising a polypeptide system as described herein; (b) contacting the cells with: (i) the guide nucleic acids for the sequence-specific nucleases of the polypeptide system; and (ii) a detection nucleic acid comprising: (1) at least one recombinase recognition sequence (RRS); and (2) the coding sequence for a detectable marker; (c) detecting the detectable marker; and (d) determining that the target nucleic acid is present in the cell if the detectable marker is detected, or determining that the target nucleic acid is not present in the cell if the detectable marker is not detected.

In some embodiments of any of the aspects, the first and second sequence-specific nuclease ($N^A$ and $N^B$) in combination with their guide nucleic acids specifically bind to the target nucleic acid.

In some embodiments of any of the aspects, the first and second polypeptide fragments of the recombinase are brought into close proximity, resulting in complementation of the two recombinase polypeptide fragments to form the active recombinase protein.

In some embodiments of any of the aspects, the active recombinase protein specifically binds to the at least one RRS in the detection nucleic acid, causing a recombination event that allows for expression of the detectable marker polypeptide.

In one aspect described herein is a method of modulating the expression of a target polypeptide, comprising: (a) providing a population of cells comprising a polypeptide system as described herein; and (b) contacting the cells with the guide nucleic acid for the sequence-specific nuclease of the polypeptide system.

In some embodiments of any of the aspects, the method further comprises contacting the cells with a target nucleic acid encoding the target polypeptide, wherein the target nucleic acid comprises sites specifically bound and cleaved by the active sequence-specific nuclease of the polypeptide system.

In some embodiments of any of the aspects, the method further comprises contacting the cells with a target nucleic acid encoding the target polypeptide, wherein the target nucleic acid comprises recombination sites specifically bound and cleaved by the active recombinase of the polypeptide system.

A method of treating a subject in need of a cell-based therapy, comprising: (a) administering to the subject a population of cells comprising a polypeptide system as described herein; and (b) administering to the subject an effective amount of the guide nucleic acid for the sequence-specific nuclease of the polypeptide system.

In some embodiments of any of the aspects, the method further comprises administering a target nucleic acid encoding the target polypeptide, wherein the target nucleic acid comprises sites specifically bound and cleaved by the active sequence-specific nuclease of the polypeptide system.

In some embodiments of any of the aspects, the method further comprises administering a target nucleic acid encoding the target polypeptide, wherein the target nucleic acid comprises recombination sites specifically bound and cleaved by the active recombinase of the polypeptide system.

In some embodiments of any of the aspects, in the presence of the guide nucleic acid and target nucleic acid(s), the recombinase and/or nuclease are active.

In some embodiments of any of the aspects, in the absence of the guide nucleic acid and target nucleic acid(s), the recombinase and/or nuclease are inactive.

In some embodiments of any of the aspects, the expression of the target polypeptide is increased when the active recombinase or active sequence-specific nuclease cleaves a portion of the target polynucleotide that inhibits expression of the target polypeptide.

In some embodiments of any of the aspects, the expression of the target polypeptide is decreased when the active recombinase or active sequence-specific nuclease cleaves a portion of the target polynucleotide that induces expression of the target polypeptide or a portion of the target polynucleotide that encodes for the target polypeptide.

In some embodiments of any of the aspects, the first and/or second polypeptide further comprises a cytosolic sequestering domain.

In some embodiments of any of the aspects, the method further comprises contacting the cell with a ligand for the cytosolic sequestering domain.

In some embodiments of any of the aspects, the method further comprises administering a ligand for the cytosolic sequestering domain.

In one aspect described herein is a method of modulating the expression of a target polypeptide, comprising: (a) providing a population of cells comprising a polypeptide system as described herein; and (b) contacting the cells with a ligand for the cytosolic sequestering domain.

A method of treating a subject in need of a cell-based therapy, comprising: (a) administering to the subject a population of cells comprising a polypeptide system as described herein; and (b) administering to the subject an effective amount of a ligand for the cytosolic sequestering domain.

In some embodiments of any of the aspects, in the presence of the ligand for the cytosolic sequestering domain, the first or second polypeptide is translocated to the nucleus.

In some embodiments of any of the aspects, in the presence of the ligand for the cytosolic sequestering domain, the first or second polypeptide binds to its cognate second or first polypeptide in the nucleus.

In some embodiments of any of the aspects, in the absence of the ligand for the cytosolic sequestering domain, the first or second polypeptide is not translocated to the nucleus.

In some embodiments of any of the aspects, in the absence of the ligand for the cytosolic sequestering domain, the first or second polypeptide does not bind to its cognate second or first polypeptide in the nucleus.

In some embodiments of any of the aspects, the first and/or second polypeptide is operatively linked to an inducible promoter.

In some embodiments of any of the aspects, the method further comprises contacting the cell with a ligand for the inducible promoter.

In some embodiments of any of the aspects, the method further comprises administering a ligand for the inducible promoter.

In one aspect described herein is a method of modulating the expression of a target polypeptide, comprising: (a) providing a population of cells comprising a polynucleotide or polynucleotide system as described herein; and (b) contacting the cells with a ligand for the inducible promoter.

In one aspect described herein is a method of treating a subject in need of a cell-based therapy, comprising: (a) administering to the subject a population of cells comprising a polynucleotide or polynucleotide system as described herein; and (b) administering to the subject an effective amount of a ligand for the inducible promoter.

In some embodiments of any of the aspects, in the presence of the ligand for the inducible promoter, the first and/or second polypeptide is expressed.

In some embodiments of any of the aspects, in the absence of the ligand for the inducible promoter, the first and/or second polypeptide is not expressed.

In some embodiments of any of the aspects, there is a lag time of 30 seconds or less in between protein complementation of the two polypeptide fragments in the presence of the inducer agent or inducer signal and the protein being in its active state.

In some embodiments of any of the aspects, there is a lag time of 30 seconds or less in between protein complementation of the two polypeptide fragments in the absence of the repressor agent or repressor signal and the protein being in its active state.

In some embodiments of any of the aspects, there is a lag time of 30 seconds or less in between protein un-complementation of the two polypeptide fragments in the presence of the repressor agent or repressor signal and the protein being in its inactive state.

In some embodiments of any of the aspects, there is a lag time of 30 seconds or less in between protein complementation of the two polypeptide fragments in the presence of the guide nucleic acids and the protein being in its active state.

In some embodiments of any of the aspects, there is a lag time of 30 seconds or less in between protein complementation of the two polypeptide fragments in the presence of the guide nucleic acid and the protein being in its active state.

In some embodiments of any of the aspects, there is a lag time of 30 seconds or less in between nuclear translocation in the presence of the ligand for the sequestering domain and the protein being in its active state.

In some embodiments of any of the aspects, there is a lag time of 30 seconds or less in between the ligand binding to the inducible promoter and the start of transcription of the polynucleotide operatively linked to the inducible promoter.

In some embodiments of any of the aspects, there is a lag time of 30 minutes or less in between the ligand binding to the inducible promoter and the start of translation of the polypeptide encoded by the polynucleotide operatively linked to the inducible promoter.

BRIEF DESCRIPTION OF THE DRAWINGS

FIG. 1A-1D is a series of schematics and graphs showing that caffeine-induced DNA recombination was achieved by fusing anti-caffeine nanobody with split recombinase at split site 270/271 in Cre. FIG. 1A shows a schematic of the design for the caffeine inducible split recombinase. FIG. 1B shows that caffeine inducible Cre was able to turn on Cre reporter in over 80% transfected cells only in the presence of both split moieties and caffeine induction in 48 hours. The performance of constitutive Cre is shown in gray.

FIG. 1C shows that recombinase activity was dependent upon caffeine concentration. While 0.01 uM caffeine was not sufficient to induce recombination, caffeine concentration over 50 uM did not increase recombination efficiency significantly. FIG. 1D shows that Cre activity positively correlated with both caffeine concentration and induction time. Cre reporter was turned on in 38% transfected cells with physiologically relevant caffeine concentration (e.g., at least 50 uM) and induction time (e.g., at least 5 hours).

FIG. 2A shows that tandem CaffVHH was able to recruit different recombinase split pairs (e.g., Cre, Flp, PhiC, vCre) and turn on recombinase activity when induced with caffeine. "0" in the first three dot plots indicates the corresponding constitutive wild-type recombinases as positive controls. GIB N172 is a GIB-inducible vCre as a positive control. For "0" and GIB N172, the negative control (reporter only; indicated by open circle for 0 and GIB N172) and the positive control (wild-type (WT) recombinase+their reporter; indicated by black square for 0 and GIB N172) were tested under no (–) caffeine conditions. FIG. 2B is a series of bar graphs showing that both tandem and single CaffVHH were able to recruit split recombinases for dimerization; after 48-hour induction with high caffeine dosage (100 uM), the activity of the tandem or single CaffVHH split recombinases was similar to each other and to the constitutive recombinase (compare second and fourth bars of each split site to far right bar). The left-right order of the bars for each split site is the same as the top-down order of the legend. Controls are shown to the far right, with the grey bar indicating Cre reporter only (negative control) and the black bar indicating Cre reporter with wild-type Cre (positive control). FIG. 2C is a series of line graphs showing that tandem and single CaffVHH generated different caffeine sensitivity when coupled with different recombinase splits.

FIG. 3A shows caffeine-inducible split Cre packed into AAV and delivered to mouse brain. Performance in mouse brain after caffeine-comprising dietary can be verified. FIG. 3B shows that NS3a split Flp is inducible with either grazoprevir or danoprevir. It can be transduced into T cells to induce CAR expression for an inducible state change from an OFF state to an ON state. T cell activity can be monitored after recombination.

FIG. 4A is a schematic showing the necessary components for the CRISPR/Cas13d system. FIG. 4B shows that Cas13d knocked down mCherry expression at various levels with efficiencies at around 80%. FIG. 4C-4D show that Cas13d effector and gRNA were both essential for the knockdown activity of the CRISPR/Cas13d system. Minimizing either one component led to the abolishment of knockdown ability. FIG. 4C shows results from various Cas13d:gRNA weights with constant gRNA concentration. FIG. 4D shows results from various gRNA:Cas13d weights with constant Cas13d concentration.

FIG. 5A shows a schematic of collateral cleavage by Cas13d induced by on-target RNA cleavage. FIG. 5B shows that collateral cleavage activity varied among different bystander fluorescent proteins (e.g., green fluorescent protein (GFP), blue fluorescent protein (BFP), infrared fluorescent protein (iRFP)). iRFP was minimally affected by mCherry on-target knockdown by Cas13d. FIG. 5C shows that collateral cleavage activity of bystander RNAs by Cas13d decreased with the dosage of targeted gene RNA (left, mCh=mCherry). As the plasmid dosage of the bystander fluorescent protein decreased, bystander expression was knocked down at a higher level.

FIG. 6A is a schematic showing split sites selected throughout RfxCas13d sequence. FIG. 6B is a bar graph showing mCherry expression under 4 conditions for gibberellin-inducible, rapalog-inducible, and abscisic acid-inducible inducible split Cas13d designs. In FIG. 6B and FIG. 6C, the left-right order of the bars for each split site is the same as the left-right order of the legend for each bar graph. FIG. 6C shows that split RfxCas13d knocked down mCherry expression in the presence of gRNAs. Some split RfxCas13d pairs knocked down mCherry expression without the help of any recruitment domain in the presence of gRNAs, while single split moieties (i.e., not in pairs) did not.

FIG. 7A is a bar graph showing additional split sites selected in RfxCas13d and tested with GIB CID domains. Split 263/264 demonstrated inducibility with minimum leaky off state activity and over 60% knockdown efficiency. In FIG. 7A and FIG. 7C, the left-right order of the bars for each split site is the same as the left-right order of the legend. FIG. 7B is a schematic showing the design to compartmentalize splits. Compartmentalizing moieties facilitates the reduction of leakiness. FIG. 7C is a bar graph showing that using a nuclear export signal (NES) and a nuclear localization sequence (NLS) to compartmentalize split the Cas13d split 599/560 shut off leaky activity in the −GIB+gRNA condition (black bars). FIG. 7D is a schematic showing the experiment flow for testing reversibility of the inducible split Cas13d's. FIG. 7E shows that PD-1, IL-2R, and HLA can be targeted and inducibly knocked down in T cells for safer, more sustained, and allogeneic T cell therapy.

FIG. 8A is a bar graph showing quantification of system performance. The left-right order of the bars for each split site is the same as the top-down order of the legend. FIG. 8B shows the Cas13d split sites and CID domains tested. System performance in leakiness score (left axis) and induced activity (right axis) by GIB, RAP, ABA, and Dano-inducible split Cas13d designs. "CID1" and "CID2" indicate first and second chemically induced dimerization domains.

FIG. 10A shows a leakiness vs. inducibility plot divided in to quadrants and representative diagrams for points in each quadrant. The left-right order of the bars for each bar graph is the same as the top-down order of the legend. FIG. 10B shows GIB inducible split Cas13d systems designed with different numbers and strength of NESs and NLSs. All optimized versions showed better performance than the original design (N-NLS+C-NLS, indicated by grey dot), with decreased leakiness and/or increased inducibility.

FIG. 12A shows the original design of 4-OHT inducible split Cas13d. This system had at least one ERT2 domain on the C-terminal split piece of Cas13d, and the N-Cas13d piece had no ERT2 domain. FIG. 12B-12C show that 508C and 566C are split sites that can be used for this system; both 508C and 566C showed improved inducibility with two ERT2 domains. Note that the NLS in the C piece sections refer to SV40 NLS. The components of designs 1-8 in FIG. 12B are indicated in FIG. 12C. In FIG. 12B-12C, the original design for split site 508C is design 3, and designs 1-2 include additional ERT and/or NLS domains; the original design for split site 566 is design 8, and designs 4-7 include additional ERT and/or NLS domains in the C-piece or the NPM2 NLS in the N piece. The grey dots in the scatterplots of FIG. 12B indicate the WT Cas13d. In FIG. 12C, the left-right order of the bars for each design is the same as the top-down order of the legend.

FIG. 13A is a schematic showing the transfection compositions of endogenous signal-responsive promoters (e.g., "short response elements" and "miniP") driving split Cas13d's. FIG. 13B is a bar graph showing that the NFkB promoter can be induced with TGFbeta to express split Cas13d or WTCas13 in order to achieve induced mCherry knockdown. FIG. 13C is a bar graph showing that the CAGA12 promoter can be induced with TNFalpha to express split Cas13d or WTCas13 in order to achieve induced mCherry knockdown. FIG. 13D is a bar graph showing that the AP1 promoter can be induced with PMA to express split Cas13d or WTCas13 in order to achieve induced mCherry knockdown. FIG. 13E is a series of bar graphs showing that orthogonality among the 3 inducible promoters tested. In FIG. 13B-13D, the left-right order of the bars for each design is the same as the top-down order of the legend for each bar graph, and "NT-gRNA" is non-target gRNA. In FIG. 13E, the left-right order of the bars is the same as the top-down order of the legend for each bar graph.

FIG. 14A shows that although the NPM2 NLS was found to be more effective at localizing to nucleus compared to SV40NLS, the design with the NPM2 NLS did not consistently reduce leakiness and was usually at the cost of inducibility. For a C split Cas13d piece with an ERT2 domain, the NLS following Cas13d was removed to reduce leakiness. The best design showing highest inducibility with low leakiness was the first set of columns (see e.g., 1 on the scatterplot in FIG. 14B). In FIG. 14A, the left-right order of the bars for each design condition is the same as the left-right order of the legend for the bar graph. FIG. 14B shows a scatterplot representation of FIG. 14A; numbers on the scatterplot correspond to columns (left-right order) in bar graph of FIG. 14A as indicated.

FIG. 15A is a bar graph showing a comparison of the C split piece with an ERT2 domain and an NLS to a similar piece without the NLS. Removal of the NLS can greatly reduce leakiness. The left-right order of the bars for each split site is the same as the left-right order of the legend for the bar graph. FIG. 15B shows a scatterplot representation of FIG. 15A; removing the NLS reduced leakiness for certain split sites like 656C.

DETAILED DESCRIPTION

Figure 1B:
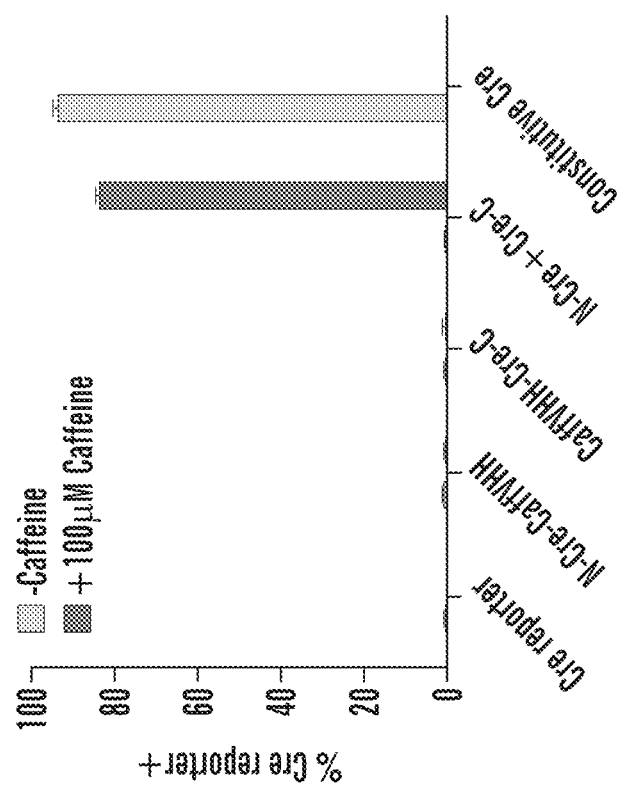

The technology described herein is directed to inducible and repressible polypeptides and polypeptide systems. In particular, described herein are split sequence-specific nucleases (e.g., Cas13d) and split recombinases (e.g., Cre) that are linked to drug-inducible or drug-repressible dimerization domains. In the absence of the drug, the two split halves of the sequence-specific nuclease or recombinase do not complement and are inactive. In the presence of the drug, the two split halves of the sequence-specific nuclease or recombinase come together to form an active protein. Such drugs include non-toxic, readily available, clinically approved molecules such as caffeine, grazoprevir, and danoprevir. The polypeptides can also comprise sequestering domains and/or have their expression controlled by an inducible promoter, which adds another layer of control to such gene expression systems. In multiple aspects described herein are polynucleotides, vectors, cells, and pharmaceutical compositions comprising said polypeptides or polypeptide systems. Also described herein are methods of using said polypeptide systems to modulate the expression of a target polypeptide or to treat a subject in need of a cell therapy.

In multiple aspects described herein are polypeptides or polypeptide systems that comprise at least one of the following: at least a fragment of a sequence-specific nuclease; at least a fragment of a recombinase; at least one member of an inducible dimerization domain; at least one member of a repressible dimerization domain; a cytosolic sequestering domain; a nuclear localization signal (NLS); a nuclear export signal (NES); a linker peptide; a self-cleaving peptide; and/or a detectable marker, or any combination thereof. In some embodiments of any of the aspects, a nuclease polypeptide or a polypeptide system collectively (i.e., the first polypeptide and/or the second polypeptide) comprises two complementary fragments of a sequence-specific nuclease that complement in the presence of an inducer agent or an inducer signal to form an active nuclease protein. In some embodiments of any of the aspects, a recombinase polypeptide or a polypeptide system collectively (i.e., the first polypeptide and/or the second polypeptide) comprises two complementary fragments of a recombinase that complement in the presence of an inducer agent or an inducer signal to form an active recombinase protein. In some embodiments of any of the aspects, the two complementary fragments of the sequence-specific nuclease or the two complementary fragments of the recombinase are brought together by: two complementary members of an inducible dimerization domain in the presence of an inducer agent or an inducer signal; two complementary members of a repressible dimerization domain in the absence of a repressor agent or a repressor signal; at least one cytosolic sequestering domain in the presence of a ligand that binds the cytosolic sequestering domain; at least one a nuclear localization signal (NLS); or at least one nuclear export signal (NES). For example, the following combinations are contemplated herein (see e.g., Table 28).

TABLE 28

Exemplary Combinations of Domains in a Polypeptide or Polypeptide System.

| NC | RC | ID | RD | CS | NL | NE |
|----|----|----|----|----|----|----|
| X  |    |    |    |    |    |    |
|    | X  |    |    |    |    |    |
| X  | X  |    |    |    |    |    |
|    |    | X  |    |    |    |    |
| X  |    | X  |    |    |    |    |
|    | X  | X  |    |    |    |    |
| X  | X  | X  |    |    |    |    |
|    |    |    | X  |    |    |    |
| X  |    |    | X  |    |    |    |
|    | X  |    | X  |    |    |    |
| X  | X  |    | X  |    |    |    |
|    |    | X  | X  |    |    |    |
| X  |    | X  | X  |    |    |    |
|    | X  | X  | X  |    |    |    |
| X  | X  | X  | X  |    |    |    |
|    |    |    |    | X  |    |    |
| X  |    |    |    | X  |    |    |
|    | X  |    |    | X  |    |    |
| X  | X  |    |    | X  |    |    |
|    |    | X  |    | X  |    |    |
| X  |    | X  |    | X  |    |    |
|    | X  | X  |    | X  |    |    |
| X  | X  | X  |    | X  |    |    |
|    |    |    | X  | X  |    |    |
| X  |    |    | X  | X  |    |    |
|    | X  |    | X  | X  |    |    |
| X  | X  |    | X  | X  |    |    |
|    |    | X  | X  | X  |    |    |
| X  |    | X  | X  | X  |    |    |
|    | X  | X  | X  | X  |    |    |
| X  | X  | X  | X  | X  |    |    |
|    |    |    |    |    | X  |    |
| X  |    |    |    |    | X  |    |
|    | X  |    |    |    | X  |    |
| X  | X  |    |    |    | X  |    |
|    |    | X  |    |    | X  |    |
| X  |    | X  |    |    | X  |    |
|    | X  | X  |    |    | X  |    |
| X  | X  | X  |    |    | X  |    |
|    |    |    | X  |    | X  |    |
| X  |    |    | X  |    | X  |    |
|    | X  |    | X  |    | X  |    |
| X  | X  |    | X  |    | X  |    |
|    |    | X  | X  |    | X  |    |
| X  |    | X  | X  |    | X  |    |
|    | X  | X  | X  |    | X  |    |
| X  | X  | X  | X  |    | X  |    |
|    |    |    |    | X  | X  |    |
| X  |    |    |    | X  | X  |    |
|    | X  |    |    | X  | X  |    |
| X  | X  |    |    | X  | X  |    |
|    |    | X  |    | X  | X  |    |
| X  |    | X  |    | X  | X  |    |
|    | X  | X  |    | X  | X  |    |
| X  | X  | X  |    | X  | X  |    |
|    |    |    | X  | X  | X  |    |
| X  |    |    | X  | X  | X  |    |
|    | X  |    | X  | X  | X  |    |
| X  | X  |    | X  | X  | X  |    |
|    |    | X  | X  | X  | X  |    |
| X  |    | X  | X  | X  | X  |    |
|    | X  | X  | X  | X  | X  |    |
| X  | X  | X  | X  | X  | X  |    |
|    |    |    |    |    |    | X  |
| X  |    |    |    |    |    | X  |
|    | X  |    |    |    |    | X  |
| X  | X  |    |    |    |    | X  |
|    |    | X  |    |    |    | X  |
| X  |    | X  |    |    |    | X  |
|    | X  | X  |    |    |    | X  |
| X  | X  | X  |    |    |    | X  |
|    |    |    | X  |    |    | X  |
| X  |    |    | X  |    |    | X  |
|    | X  |    | X  |    |    | X  |
| X  | X  |    | X  |    |    | X  |
|    |    | X  | X  |    |    | X  |
| X  |    | X  | X  |    |    | X  |
|    | X  | X  | X  |    |    | X  |
| X  | X  | X  | X  |    |    | X  |
|    |    |    |    | X  |    | X  |
| X  |    |    |    | X  |    | X  |

TABLE 28-continued

Exemplary Combinations of Domains in a Polypeptide or Polypeptide System.

| NC | RC | ID | RD | CS | NL | NE |
|---|---|---|---|---|---|---|
|  | X |  |  | X |  | X |
| X | X |  |  | X |  | X |
|  |  | X |  | X |  | X |
| X |  | X |  | X |  | X |
|  | X | X |  | X |  | X |
| X | X | X |  | X |  | X |
|  |  |  | X | X |  | X |
| X |  |  | X | X |  | X |
|  | X |  | X | X |  | X |
| X | X |  | X | X |  | X |
|  |  | X | X | X |  | X |
| X |  | X | X | X |  | X |
|  | X | X | X | X |  | X |
| X | X | X | X | X |  | X |
|  |  |  |  |  | X | X |
| X |  |  |  |  | X | X |
|  | X |  |  |  | X | X |
| X | X |  |  |  | X | X |
|  |  | X |  |  | X | X |
| X |  | X |  |  | X | X |
|  | X | X |  |  | X | X |
| X | X | X |  |  | X | X |
|  |  |  | X |  | X | X |
| X |  |  | X |  | X | X |
|  | X |  | X |  | X | X |
| X | X |  | X |  | X | X |
|  |  | X | X |  | X | X |
| X |  | X | X |  | X | X |
|  | X | X | X |  | X | X |
| X | X | X | X |  | X | X |
|  |  |  |  | X | X | X |
| X |  |  |  | X | X | X |
|  | X |  |  | X | X | X |
| X | X |  |  | X | X | X |
|  |  | X |  | X | X | X |
| X |  | X |  | X | X | X |
|  | X | X |  | X | X | X |
| X | X | X |  | X | X | X |
|  |  |  | X | X | X | X |
| X |  |  | X | X | X | X |
|  | X |  | X | X | X | X |
| X | X |  | X | X | X | X |
|  |  | X | X | X | X | X |
| X |  | X | X | X | X | X |
|  | X | X | X | X | X | X |
| X | X | X | X | X | X | X |

"NC" indicates at least a fragment of a sequence-specific nuclease. "RC" indicates at least a fragment of a recombinase. "ID" indicates at least one member of an inducible dimerization domain. "RD" indicates at least one member of a repressible dimerization domain. "CS" indicates cytosolic sequestering domain. "NL" indicates nuclear localization signal. "NE" indicates nuclear export signal.

In several aspects, described herein are polypeptides comprising at least a fragment of a sequence-specific nuclease. In some embodiments of any of the aspects, a nuclease polypeptide system collectively (i.e., the first polypeptide and/or the second polypeptide) comprises two complementary fragments of a sequence-specific nuclease that can combine to form an active sequence-specific nuclease protein.

In some embodiments, a sequence-specific nuclease is split into at least two, or at least 3 or more split-nuclease polypeptide fragments. As an exemplary embodiment, a sequence-specific nuclease protein is split into an N-terminal fragment (typically referred to herein as a "a first polypeptide fragment of a sequence-specific nuclease ($N^1$)" or "first nuclease polypeptide fragment") and a C-terminal fragment (typically referred to herein as a "a second polypeptide fragment of a sequence-specific nuclease ($N^2$)" or "second nuclease polypeptide fragment"). In some embodiments of any of the aspects, at least one of the nuclease fragments are conjugated or attached, either directly (e.g., peptide bonds, covalent bonds or cross-linkers), or indirectly (e.g., with peptide linkers and the like) to one member of an inducible dimerization domain, one member of repressible dimerization domain, a sequestering domain, or at least a portion of a recombinase, as described further herein. The present technology is advantageous over existing methods to control recombinase activity, in that it can be inducible by a drug or inducer agent, and does not rely on gene expression, and therefore, works in a variety of different types of cells (prokaryotes, eukaryotes), as well as a cell-free system.

Split-nuclease polypeptide fragments as disclosed herein can be any polypeptide fragments of a nuclease protein which associate when brought in to close proximity to generate the active nuclease protein. That is, the split-nuclease polypeptide fragments by themselves are not active, it is only when they come together by protein complementation, to generate the active nuclease enzyme. In one embodiment of the technology described herein, the methods and compositions encompass the design of split-nuclease polypeptide fragments so that they are active immediately upon their reconstitution. In some embodiments, the split-nuclease polypeptide fragments are designed so that they are in the active state and primed (i.e. in a ready-state) for reconstitution of the active protein in order to minimize any lag time that is traditionally seen with protein complementation in vitro and in vivo. In some embodiments of any aspect of the present invention, the lag time before being in the active state is 30 seconds or less, 25 seconds or less, 20 seconds or less, 15 seconds or less, 10 seconds or less, 5 seconds or less.

In some embodiments, the nuclease polypeptide fragments are self-complementing fragments of the nuclease protein. Separately, the nuclease polypeptide fragments do not display the nuclease biological activity, but when physically proximate (e.g., by coming together of the attached dimerization domains; induction of the sequestering domain; presence of a guide nucleic acid specifically bound by a nuclease domain) the fragments spontaneously complement, thereby reconstituting the nuclease protein from which they were derived, restoring the nuclease phenotype. Complementary sets of such fragments are termed "split-nuclease" protein systems. These systems may be generated from any nuclease protein, e.g., Cas enzymes and variants thereof. The split-nuclease system can be used for genetic circuits, such as those disclosed in WO 2015/188191, as well as other uses are envisioned. Also encompassed in the present invention are split nuclease polypeptides, also referred to as a bi-molecular conjugate, produced by the methods described herein.

Nuclease proteins are split at location S where the N-terminal fragment of the protein is from amino acid 1 to amino acid S (inclusive) and the C-terminal fragment of the protein is from S+1 to the end of the protein.

In some embodiments of any of the aspects, the sequence-specific nuclease is a Cas (CRISPR associated protein) endonuclease. A Cas endonuclease can cleave a target nucleic acid (and/or collateral nucleic acids) in the presence of a guide nucleic acid that is complementary or substantially complementary to the target nucleic acid.

In some embodiments of any of the aspects, the Cas endonuclease is in combination with a guide nucleic acid that specifically binds to a target nucleic acid. In some embodiments of any of the aspects, the sequence-specific endonuclease binds to a guide nucleic acid (gNA), e.g., in the presence of the target nucleic acid. In some embodiments of any of the aspects, the guide nucleic acid is a guide RNA (gRNA). As used herein, the terms "guide nucleic acid," "guide sequence," "crRNA," "guide RNA," or "single guide RNA," or "gRNA" refers to a polynucleotide comprising any polynucleotide sequence. Generally, the guide nucleic acid sequence is selected to have sufficient complementarity with a target nucleic acid sequence to hybridize with the target nucleic acid sequence and to direct sequence-specific binding of the fusion protein, i.e., sequence-specific endonuclease to the target nucleic acid sequence.

The guide nucleic acid or collateral nucleic acid can be any length. For example, the guide nucleic acid or collateral nucleic acid can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments of any of the aspects, the guide nucleic acid or collateral nucleic acid is less than about 75, 50, 45, 40, 35, 30, 25, 20, 15, 12, or fewer nucleotides in length. For example, the guide nucleic acid or collateral nucleic acid is 10-30 nucleotides long. In some embodiments of any of the aspects, the guide nucleic acid is designed using a guide design tool (e.g., Benchling™; Broad Institute GPP™; CasOFFinder™; CHOPCHOP™; CRISPOR™; Deskgen™; E-CRISP™; Geneious™; GenHub™; GUIDES™ (e.g., for library design); Horizon Discovery™; IDT™; Off-Spotter™; and Synthego™; which are available on the world wide web).

In some embodiments of any of the aspects, the guide nucleic acid is complementary or substantially complementary to at least a portion of the target nucleic acid. The term "substantial complementary" or "substantially complementary" as used herein refers both to complete complementarity of binding nucleic acids, in some cases referred to as an identical sequence, as well as complementarity sufficient to achieve the desired binding of nucleic acids. Correspondingly, the term "complementary hybrids" encompasses substantially complementary hybrids.

In some embodiments of any of the aspects, the sequence specific endonuclease comprises a CRISPR-Cas protein selected from the group consisting of C2c1, C2c3, Cas1, Cas100, Cas12a, Cas12b, Cas12c, Cas12d, Cas12e, Cas13a, Cas13b, Cas13c, Cas1B, Cas2, Cas3, Cas4, Cas5, Cas6, Cas7, Cas8, Cas9 (also known as Csn1 and Csx12), Cas1, Cas1B, Cas10, Cmr1, Cmr3, Cmr4, Cmr5, Cmr6, Cpf1, Csa5, Csa5, CsaX, Csb1, Csb2, Csb3, Csc1, Csc2, Cse1, Cse2, Csf1, Csf2, Csf3, Csf4, Csm2, Csm3, Csm4, Csm5, Csm6, Csn2, Csx1, Csx10, Csx14, Csx15, Csx16, Csx17, Csx3, Csy1, Csy2, Csy3, and homologues thereof, or modified versions thereof. It is noted that the sequence specific endonuclease can be from an analog or variant of a known CRISPR-Cas protein.

In some embodiments of any of the aspects, the sequence-specific endonuclease is Cas13a (previously known as C2c2), Cas13b, Cas13c, Cas13d, Cas12a, and/or Csm6. In some embodiments of any of the aspects, the sequence-specific endonuclease is Cas12 or Cas13. See e.g., US Patent Application US20190241954; PCT Patent Application WO2020028729; Chen et al., CRISPR-Cas12a target binding unleashes indiscriminate single-stranded DNase activity, Science. 2018 Apr. 27, 360(6387):436-439; the content of each of which is incorporated herein by reference in its entirety.

In some embodiments of any of the aspects, the Cas endonuclease is Cas13 endonuclease. Cas13 is an RNA-guided RNA endonuclease. Cas13 specifically targets single-stranded RNA which means that it does not cleave DNA, but only. Cas13 is guided by its crRNA to a ssRNA target and binds and cleaves the target. Similar to Cas12a, the Cas13 remains bound to the target and then cleaves other ssRNA molecules non-discriminately (i.e., collateral nucleic acids). Accordingly, in some embodiments of any of the aspects, the Cas endonuclease exhibits collateral cleavage of non-guide nucleic acids (i.e., collateral nucleic acids). Cas13a, Cas13b, and Cas13d have been reported to have minimal collateral cleavage activity in mammalian systems; as such, in some embodiments of any of the aspects, the Cas endonuclease does not exhibit collateral cleavage of non-guide nucleic acids (i.e., collateral nucleic acids).

Cas13 possesses the ability to process a pre-CRISPR RNA array for multiplexed knockdown activity. Accordingly, in some embodiments of any of the aspects, the Cas endonuclease can process pre-guide nucleic arrays to produce multiple guide nucleic acids each targeting a different target nucleic acid. In some embodiments of any of the aspects, the pre-guide nucleic array comprises at least 2, at least 3, at least 4, at least 5, at least 6, at least 7, at least 8, at least 9, at least 10, at least 20, at least 30, at least 40, at least 50, at least 60, at least 70, at least 80, at least 90, at least 100, at least 200, at least 300, at least 400, at least 500, at least 600, at least 700, at least 800, at least 900, at least 1000, or more guide nucleic acids or pre-guide nucleic acids.

The CRISPR-Cas13 system can be used to knock down circular RNAs (circRNAs), without any impact on related mRNAs, e.g., by designing guide nucleic acids that target sequences spanning a back-splicing junction; see e.g., Li et al., Nature Methods 18, 51-59 (2021), the contents of which are incorporated herein by reference in its entirety. Accordingly, in some embodiments of any of the aspects, the target nucleic acid is a circular nucleic acid.

There are at least 4 subtypes of Cas13: Cas13a, Cas13b, Cas13c, and Cas13d, among which, Cas13a, Cas13b, and Cas13d do not require any protospacer flanking sequence (PFS) for efficient gene targeting in mammalian cells, thus, are less restricted in target nucleic acid sites. Accordingly, in some embodiments of any of the aspects, the Cas13 endonuclease is Cas13a, Cas13b, or Cas13d. All known Cas13 family members contain two HEPN domains, which confer RNase activity.

Cas13a, Cas13b, and Cas13d demonstrate ortholog-specific restrictions with respect to their guide nucleic acids. Cas13a, demonstrates a sequence constraint, termed the Protospacer Flanking Sequence (PFS), both in vitro as well as in bacterial cells. Immunization of E. coli against MS2 phage by heterologous expression of the LshCas13a system depended on the presence of a 3' H (not G) base immediately flanking the protospacer sequence. Similar PFS restrictions have been observed in bacteria for Cas13b. An additional factor that must be considered when targeting single-stranded RNA species in vivo is the accessibility of the target due to higher-order structures. In vitro, Cas13 cleaves near unstructured regions of the target RNA, and in vivo, predicted secondary structure (e.g., double-stranded RNA) is negatively correlated with knockdown in bacteria or mammalian cells, as Cas13 requires a single-stranded substrate and likely lacks the helicase activity necessary for opening up double-stranded RNA regions for guide binding. Accordingly, guide nucleic acids for Cas13a, Cas13b, or Cas13d are provided based on each enzyme's ortholog-specific guide restrictions See e.g., Abudayyeh et al., Science 2016; Smargon et al., Molecular cell 2017, 65(4):618-630.e7; Cox et al., Science 2017; Bandaru et al., Scientific Reports volume 10, Article number: 11610 (2020); the contents of each of which are incorporated herein by reference in their entireties.

In some embodiments of any of the aspects, polypeptide systems described herein comprise a first polypeptide fragment of a sequence-specific nuclease ($N^1$) and a second polypeptide fragment of a sequence-specific nuclease ($N^2$). In some embodiments of any of the aspects, the first and second polypeptide fragments are complementary, e.g., can come together to form an active nuclease protein. In some embodiments of any of the aspects, the first polypeptide fragment of the sequence-specific nuclease ($N^1$) comprises an N-terminal polypeptide fragment of the sequence-specific nuclease. In some embodiments of any of the aspects, the second polypeptide fragment of the sequence-specific nuclease ($N^2$) comprises a C-terminal polypeptide fragment of the sequence-specific nuclease. In some embodiments of any of the aspects, N-terminal amino acid of $N^2$ is the amino acid residue immediately after the C-terminal amino acid of $N^1$, with reference to the full-length sequence-specific nuclease (see e.g., SEQ ID NOs: 1-3); such amino acids can be referred to herein as the split site. In some embodiments of any of the aspects, the numbering of the split site does not include the first methionine in the protein sequence of the sequence-specific nuclease (see e.g., SEQ ID NOs: 1-3).

In some embodiments of any of the aspects, the Cas13 endonuclease is Cas13d. In some embodiments of any of the aspects, the Cas endonuclease is derived from the *Ruminococcus flavefaciens* Cas13d (RfxCas13d). RfxCas13d has robust and substantial knockdown of target nucleic acid in HEK293T cells, including 80-95% efficiency with mCherry reporter and endogenous transcripts. In some embodiments of any of the aspects, the Cas endonuclease is derived from the *Eubacterium siraeum* DSM15702 (EsCas13d) or Ruminococcus sp. NJS.MGS-57 (RspCas13d). See e.g., Konermann et al. (2018) Cell, 173(3), 665-676.; see e.g., Yan et al., 2018, Molecular Cell 70, 327-339; the contents of each of which are incorporated herein by reference in their entirety.

In some embodiments of any of the aspects, the Cas13d comprises the sequence of SEQ ID NO: 1 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 1 that maintains the same function (e.g., sequence-specific cleavage of target nucleic acid and/or collateral nucleic acid) or a functional fragment thereof. In some embodiments of any of the aspects, the Cas13d comprises the sequence of SEQ ID NO: 1 or a sequence that is at least 85% identical to SEQ ID NO: 1 that maintains the same function. In some embodiments of any of the aspects, the Cas13d comprises the sequence of SEQ ID NO: 1 or a sequence that is at least 95% identical to SEQ ID NO: 1 that maintains the same function.

type VI-D CRISPR-associated RNA-guided
ribonuclease Cas13d *Ruminococcus flavefaciens*,
NCBI Reference Sequence: WP_075424065.1,
966 amino acids (aa)

SEQ ID NO: 1
IEKKKSFAKGMGVKSTLVSGSKVYMTTFAEGSDARLEKIVEGDSIRSVNE

GEAFSAEMADKNAGYKIGNAKFSHPKGYAVVANNPLYTGPVQQDMLGLKE

-continued

TLEKRYFGESADGNDNICIQVIHNILDIEKILAEYITNAAYAVNNISGLD

KDIIGFGKFSTVYTYDEFKDPEHHRAAFNNNDKLINAIKAQYDEFDNFLD

NPRLGYFGQAFFSKEGRNYIINYGNECYDILALLSGLRHWVVHNNEEESR

ISRTWLYNLDKNLDNEYISTLNYLYDRITNELTNSFSKNSAANVNYIAET

LGINPAEFAEQYFRFSIMKEQKNLGFNITKLREVMLDRKDMSEIRKNHKV

FDSIRTKVYTMMDFVIYRYYIEEDAKVAAANKSLPDNEKSLSEKDIFVIN

LRGSFNDDQKDALYYDEANRIWRKLENIMHNIKEFRGNKTREYKKKDAPR

LPRILPAGRDVSAFSKLMYALTMFLDGKEINDLLTTLINKFDNIQSFLKV

MPLIGVNAKFVEEYAFFKDSAKIADELRLIKSFARMGEPIADARRAMYID

AIRILGTNLSYDELKALADTFSLDENGNKLKKGKHGMRNFIINNVISNKR

FHYLIRYGDPAHLHEIAKNEAVVKFVLGRIADIQKKQGQNGKNQIDRYYE

TCIGKDKGKSVSEKVDALTKIITGMNYDQFDKKRSVIEDTGRENAEREKF

KKIISLYLTVIYHILKNIVNINARYVIGFHCVERDAQLYKEKGYDINLKK

LEEKGFSSVTKLCAGIDETAPDKRKDVEKEMAERAKESIDSLESANPKLY

ANYIKYSDEKKAEEFTRQINREKAKTALNAYLRNTKWNVIIREDLLRIDN

KTCTLFRNKAVHLEVARYVHAYINDIAEVNSYFQLYHYIMQRIIMNERYE

KSSGKVSEYFDAVNDEKKYNDRLLKLLCVPFGYCIPRFKNLSIEALFDRN

Figure 6A:
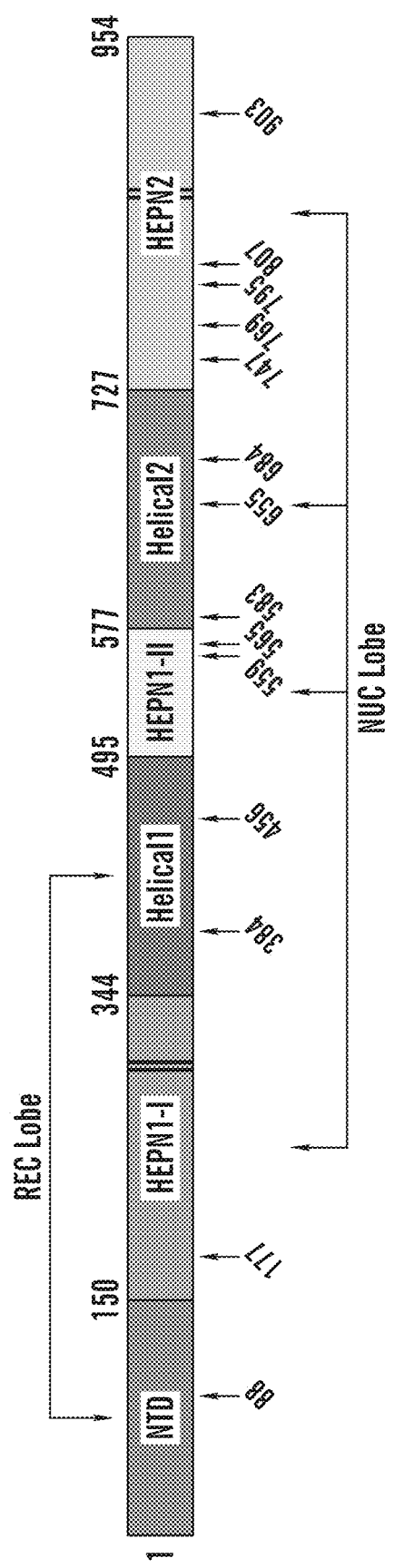
FIG. 6A-6C is a series of schematics and graphs showing that split RfxCas13d's reconstituted and functioned to knockdown mCherry expression in HEK293 FT cells
Figure 8A:
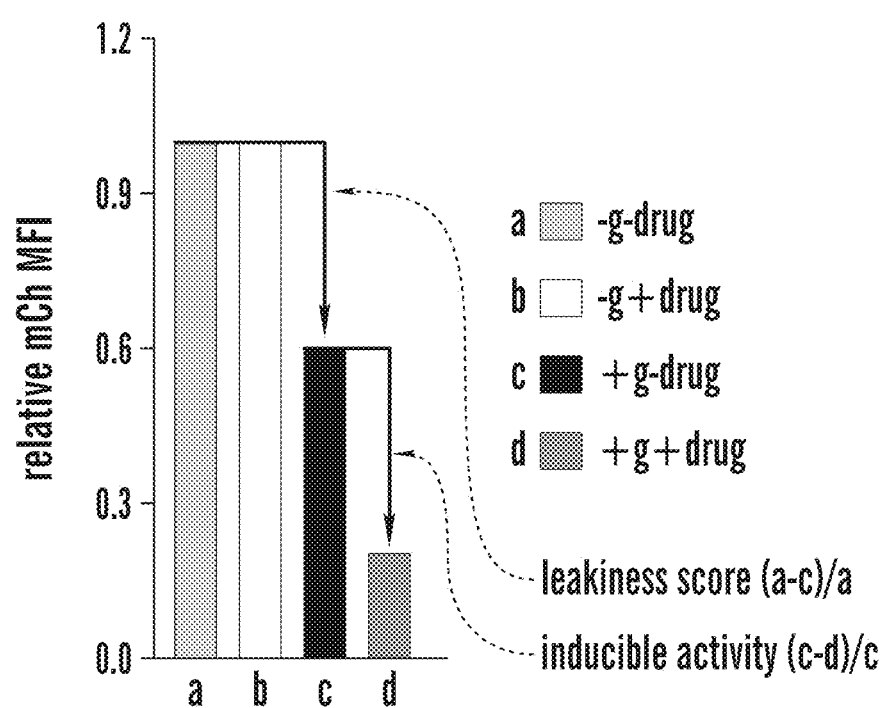
FIG. 8A-8B is a series of schematics and graphs showing that split RfxCas13d's reconstituted upon drug-induced dimerization and knocked down mCherry expression in HEK293 FT cells.
Figure 8B:
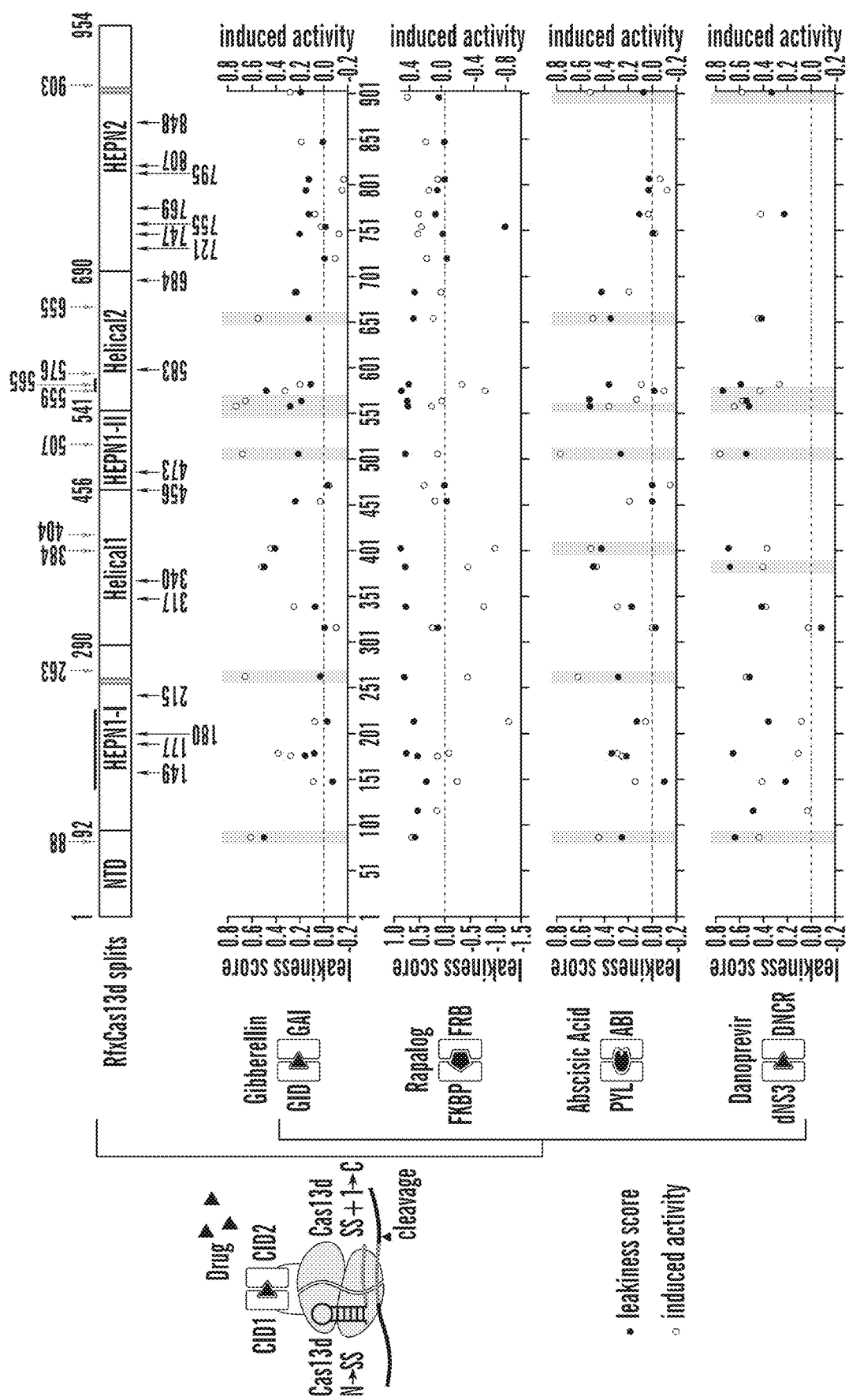

EAAKFDKEKKKVSGNS,

The structural information used to screen split sites was extracted from alignment of RfxCas13d to EsCas13d, which aligned up until aa 954 of RfxCas13d (see e.g., FIG. 6A, FIG. 8B). Non-limiting examples of split sites for RfxCas13d are provided in Table 2 using SEQ ID NO: 1. In some embodiments of any of the aspects, $N^1$ and $N^2$ are selected from the group of 27 split sites in Table 2, or a portion of the 27 split sites in Table 2 (e.g., the 14 split sites of Set 1; the 13 split sites of Set 2; or 10 select split sites; see e.g., FIG. 6A, FIG. 8B). In some embodiments of any of the aspects, split sites for Cas13d polypeptides other than RfxCas13d (see e.g., SEQ ID NO: 1) or for Cas13a (see e.g., SEQ ID NO: 2) or Cas13b (see e.g., SEQ ID NO: 3) can be selected by aligning the Cas13 polypeptide with the RfxCas13d (see e.g., SEQ ID NO: 1) and selecting the split site in the Cas13 polypeptide corresponding to one of the 27 exemplary split sites in RfxCas13d (see e.g., SEQ ID NO: 1, SEQ ID NOs: 4-57, Table 2).

TABLE 2

Exemplary RfxCas13d polypeptide fragments (the first methionine is not included in the numbering of SEQ ID NO: 1).

| Split-Cas13d | N-terminal fragment (aa of SEQ ID NO: 1) | SEQ ID NO: | C-terminal fragment (aa of SEQ ID NO: 1) | SEQ ID NO: | Set 1 | Set 2 | Select |
|---|---|---|---|---|---|---|---|
| 88/89 | 1-88 (Cas13d 88N) | 4 | 89-966 (Cas13d C89) | 5 | x | | x |
| 149/150 | 1-149 (Cas13d 149N) | 6 | 150-966 (Cas13d C150) | 7 | | x | |
| 177/178 | 1-177 (Cas13d 177N) | 8 | 178-966 (Cas13d C178) | 9 | x | | |
| 180/181 | 1-180 (Cas13d 180N) | 10 | 181-966 (Cas13d C181) | 11 | | x | |
| 215/216 | 1-215 (Cas13d 215N) | 12 | 216-966 (Cas13d C216) | 13 | | x | |
| 263/264 | 1-263 (Cas13d 263N) | 14 | 264-966 (Cas13d C264) | 15 | | x | x |
| 317/318 | 1-317 (Cas13d 317N) | 16 | 318-966 (Cas13d C318) | 17 | | x | |
| 340/341 | 1-340 (Cas13d 340N) | 18 | 341-966 (Cas13d C341) | 19 | | x | |
| 384/385 | 1-384 (Cas13d 384N) | 20 | 385-966 (Cas13d C385) | 21 | x | | x |
| 404/405 | 1-404 (Cas13d 404N) | 22 | 405-966 (Cas13d C405) | 23 | | x | x |
| 456/457 | 1-456 (Cas13d 456N) | 24 | 457-966 (Cas13d C457) | 25 | x | | |
| 473/474 | 1-473 (Cas13d 473N) | 26 | 474-966 (Cas13d C474) | 27 | | x | |
| 507/508 | 1-507 (Cas13d 507N) | 28 | 508-966 (Cas13d C508) | 29 | | x | x |
| 559/560 | 1-559 (Cas13d 559N) | 30 | 560-966 (Cas13d C560) | 31 | x | | x |
| 565/566 | 1-565 (Cas13d 565N) | 32 | 566-966 (Cas13d C566) | 33 | x | | x |
| 576/577 | 1-576 (Cas13d 576N) | 34 | 577-966 (Cas13d C577) | 35 | | x | x |
| 583/584 | 1-583 (Cas13d 583N) | 36 | 584-966 (Cas13d C584) | 37 | x | | |
| 655/656 | 1-655 (Cas13d 655N) | 38 | 656-966 (Cas13d C656) | 39 | x | | x |
| 684/685 | 1-684 (Cas13d 684N) | 40 | 685-966 (Cas13d C685) | 41 | x | | |
| 721/722 | 1-721 (Cas13d 721N) | 42 | 722-966 (Cas13d C722) | 43 | | x | |
| 747/748 | 1-747 (Cas13d 747N) | 44 | 748-966 (Cas13d C748) | 45 | x | | |
| 755/756 | 1-755 (Cas13d 755N) | 46 | 756-966 (Cas13d C756) | 47 | | x | |
| 769/770 | 1-769 (Cas13d 769N) | 48 | 770-966 (Cas13d C770) | 49 | x | | |
| 795/796 | 1-795 (Cas13d 795N) | 50 | 796-966 (Cas13d C796) | 51 | x | | |
| 807/808 | 1-807 (Cas13d 807N) | 52 | 808-966 (Cas13d C808) | 53 | x | | |
| 848/849 | 1-848 (Cas13d 848N) | 54 | 849-966 (Cas13d C849) | 55 | | x | |
| 903/904 | 1-903 (Cas13d 903N) | 56 | 904-966 (Cas13d C904) | 57 | x | | x |

In some embodiments of any of the aspects, a N-terminal Cas13d polypeptide fragment comprises a continuous stretch of amino acids of a fragment of the N-terminal of SEQ ID NO: 1, where the C-terminus of such a N-terminal Cas13d fragment ends anywhere between amino acids 1-10, 11-20, 21-30, 31-40, 41-50, 51-60, 61-70, 71-80, 81-90, 91-100, 101-10, 111-20, 121-130, 131-140, 141-150, 151-160, 161-170, 171-180, 181-190, 191-200, 201-210, 211-220, 221-230, 231-240, 241-250, 251-260, 261-270, 271-280, 281-290, 291-300, 301-310, 311-320, 321-330, 331-340, 341-350, 351-360, 361-370, 371-380, 381-390, 391-400, 401-410, 411-420, 421-430, 431-440, 441-450, 451-460, 461-470, 471-480, 481-490, 491-500, 501-510, 511-520, 521-530, 531-540, 541-550, 551-560, 561-570, 571-580, 581-590, 591-600, 601-610, 611-620, 621-630, 631-640, 641-650, 651-660, 661-670, 671-680, 681-690, 691-700, 701-710, 711-720, 721-730, 731-740, 741-750, 751-760, 761-770, 771-780, 781-790, 791-800, 801-810, 811-820, 821-830, 831-840, 841-850, 851-860, 861-870, 871-880, 881-890, 891-900, 901-910, 911-920, 921-930, 931-940, 941-950, 951-960, or 961-966 of SEQ ID NO: 1, or a polypeptide of at least 70%, 80%, 85%, 90%, 95%, 97%, 98%, or 99% identity to SEQ ID NO: 1.

In such embodiments, a C-terminal Cas13d polypeptide fragment comprises a continuous stretch of amino acids of a fragment of the C-terminal of SEQ ID NO: 1, where the N-terminus of such a C-terminal Cas13d fragment begins anywhere between amino acids 1-10, 11-20, 21-30, 31-40, 41-50, 51-60, 61-70, 71-80, 81-90, 91-100, 101-10, 111-20, 121-130, 131-140, 141-150, 151-160, 161-170, 171-180, 181-190, 191-200, 201-210, 211-220, 221-230, 231-240, 241-250, 251-260, 261-270, 271-280, 281-290, 291-300, 301-310, 311-320, 321-330, 331-340, 341-350, 351-360, 361-370, 371-380, 381-390, 391-400, 401-410, 411-420, 421-430, 431-440, 441-450, 451-460, 461-470, 471-480, 481-490, 491-500, 501-510, 511-520, 521-530, 531-540, 541-550, 551-560, 561-570, 571-580, 581-590, 591-600, 601-610, 611-620, 621-630, 631-640, 641-650, 651-660, 661-670, 671-680, 681-690, 691-700, 701-710, 711-720, 721-730, 731-740, 741-750, 751-760, 761-770, 771-780, 781-790, 791-800, 801-810, 811-820, 821-830, 831-840, 841-850, 851-860, 861-870, 871-880, 881-890, 891-900, 901-910, 911-920, 921-930, 931-940, 941-950, 951-960, or 961-966 of SEQ ID NO: 1, or a polypeptide of at least 70%, 80%, 85%, 90%, 95%, 97%, 98%, or 99% identity to SEQ ID NO: 1.

In some embodiments of any of the aspects, a N-terminal Cas13d polypeptide fragment comprises a continuous stretch of amino acids of a fragment of the N-terminal of SEQ ID NO: 1, where the C-terminus of such a N-terminal Flp fragment ends at an amino acid selected from Table 2. In some embodiments of any of the aspects, a N-terminal Cas13d polypeptide fragment comprises amino acids of one of SEQ ID NOs: 4, 6, 8, 10, 12, 14, 16, 18, 20, 22, 24, 26, 28, 30, 32, 34, 36, 38, 40, 42, 44, 46, 48, 50, 52, 54, or 56 or a polypeptide of at least 70% or 80% or 85% or 90%, or 95% or 97% or 98% or 99% identity one of SEQ ID NOs: 4, 6, 8, 10, 12, 14, 16, 18, 20, 22, 24, 26, 28, 30, 32, 34, 36, 38, 40, 42, 44, 46, 48, 50, 52, 54, or 56. In some embodiments of any of the aspects, a N-terminal Cas13d polypeptide fragment comprises a functional C-terminal fragment of one of SEQ ID NOs: 4, 6, 8, 10, 12, 14, 16, 18, 20, 22, 24, 26, 28, 30, 32, 34, 36, 38, 40, 42, 44, 46, 48, 50, 52, 54, or 56, e.g., at least 1, 2, 3, 4, 5, 6, 7, 8, 9, 10, between 10-20, between 20-30, between 10-50, or more than 50 amino acids are missing from the N-terminal of one of SEQ ID NOs: 4, 6, 8, 10, 12, 14, 16, 18, 20, 22, 24, 26, 28, 30, 32, 34, 36, 38, 40, 42, 44, 46, 48, 50, 52, 54, or 56.

In some embodiments of any of the aspects, a C-terminal Cas13d polypeptide fragment comprises a continuous stretch of amino acids of a fragment of the C-terminal of SEQ ID NO: 1, where the N-terminus of such a C-terminal Flp fragment ends at an amino acid selected from Table 2. In some embodiments of any of the aspects, a C-terminal Cas13d polypeptide fragment comprises amino acids of one of SEQ ID NOs: 5, 7, 9, 11, 13, 15, 17, 19, 21, 23, 25, 27, 29, 31, 33, 35, 37, 39, 41, 43, 45, 47, 49, 51, 53, 55, or 57 or a polypeptide of at least 70% or 80% or 85% or 90%, or 95% or 97% or 98% or 99% identity one of SEQ ID NOs: 5, 7, 9, 11, 13, 15, 17, 19, 21, 23, 25, 27, 29, 31, 33, 35, 37, 39, 41, 43, 45, 47, 49, 51, 53, 55, or 57. In some embodiments of any of the aspects, a C-terminal Cas13d polypeptide fragment comprises a functional N-terminal fragment of one of SEQ ID NOs: 5, 7, 9, 11, 13, 15, 17, 19, 21, 23, 25, 27, 29, 31, 33, 35, 37, 39, 41, 43, 45, 47, 49, 51, 53, 55, or 57, e.g., at least 1, 2, 3, 4, 5, 6, 7, 8, 9, 10, between 10-20, between 20-30, between 10-50, or more than 50 amino acids are missing from the C-terminal of one of SEQ ID NOs: 5, 7, 9, 11, 13, 15, 17, 19, 21, 23, 25, 27, 29, 31, 33, 35, 37, 39, 41, 43, 45, 47, 49, 51, 53, 55, or 57.

In some embodiments of any of the aspects, $N^1$ comprises a N-terminal polypeptide fragment of SEQ ID NO: 1 with the C-terminus ending at amino acid 88 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 89 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 177 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 178 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 384 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 385 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 456 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 457 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 559 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 560 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 565 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 566 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 583 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 584 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 655 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 656 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 684 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 685 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 747 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 748 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 769 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 770 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 795 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 796 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 807 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 808 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 903 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 904 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 149 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 150 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 180 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 181 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 215 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 216 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 263 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 264 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 317 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 318 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 340 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 341 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 404 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 405 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 473 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 474 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 507 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 508 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 576 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 577 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 721 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 722 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 755 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 756 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, $N^1$ comprises a N-terminal polypeptide fragment of SEQ ID NO: 1 with the C-terminus ending at amino acid 848 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1. In some embodiments of any of the aspects, $N^2$ comprises a C-terminal polypeptide fragment of SEQ ID NO: 1 with the N-terminus beginning at amino acid 849 of SEQ ID NO: 1 or a polypeptide that is at least 70%, at least 80%, at least 85%, at least 90%, at least 95%, at least 96%, at least 97%, at least 98%, or at least 99% identical to SEQ ID NO: 1.

In some embodiments of any of the aspects, the Cas13 endonuclease is Cas13a. In some embodiments of any of the aspects, the Cas endonuclease is derived from the *Leptotrichia wadei* Cas13a (LwaCas13a). LwaCas13b has demonstrated 50% knockdown efficiency using luciferase and endogenous transcripts; see e.g., Abudayyeh et al. (2016) Science, 353(6299). In some embodiments of any of the aspects, the Cas13a comprises the sequence of SEQ ID NO: 2 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 2 that maintains the same function (e.g., sequence-specific cleavage of target nucleic acid and/or collateral nucleic acid) or a functional fragment thereof. In some embodiments of any of the aspects, the Cas13a comprises the sequence of SEQ ID NO: 2 or a sequence that is at least 85% identical to SEQ ID NO: 2 that maintains the same function. In some embodiments of any of the aspects, the Cas13a comprises the sequence of SEQ ID NO: 2 or a sequence that is at least 95% identical to SEQ ID NO: 2 that maintains the same function. In some embodiments of any of the aspects, the Cas13a (e.g., SEQ ID NO: 2) comprises a glycine (G; Gly) at amino acid residue 403. In some embodiments of any of the aspects, the Cas13a (e.g., SEQ ID NO: 2) comprises an aspartic acid (D; Asp) at amino acid residue 403.

```
type VI-A CRISPR-associated RNA-guided
ribonuclease Cas13a Leptotrichia wadei, 1152 aa;
see e.g., NCBI Reference Sequence:
WP_021746774.1:
                                          SEQ ID NO: 2
MKVTKVDGISHKKYIEEGKLVKSTSEENRTSERLSELLSIRLDIYIKNPD

NASEEENRIRRENLKKFFSNKVLHLKDSVLYLKNRKEKNAVQDKNYSEED

ISEYDLKNKNSFSVLKKILLNEDVNSEELEIFRKDVEAKLNKINSLKYSF

EENKANYQKINENNVEKVGGKSKRNHYDYYRESAKRNDYINNVQEAFDKL

YKKEDIEKLFFLIENSKKHEKYKIREYYHKIIGRKNDKENFAKIIYEEIQ

NVNNIKELIEKIPDMSELKKSQVFYKYYLDKEELNDKNIKYAFCHFVEIE

MSQLLKNYVYKRLSNISNDKIKRIFEYQNLKKLIENKLLNKLDTYVRNCG

KYNYYLQVGEIATSDFIARNRQNEAFLRNIIGVSSVAYFSLRNILETENE

NGITGRMRGKTVKNNKGEEKYVSGEVDKIYNENKQNEVKENLKMFYSYDF

NMDNKNEIEDFFANIDEAISSIRHGIVHFNLELEGKDIFAFKNIAPSEIS

KKMFQNEINEKKLKLKIFKQLNSANVFNYYEKDVIIKYLKNTKFNFVNKN

IPFVPSFTKLYNKIEDLRNTLKFFWSVPKDKEEKDAQIYLLKNIYYGEFL

NKFVKNSKVFFKITNEVIKINKQRNQKTGHYKYQKFENIEKTVPVEYLAI
```

-continued
IQSREMINNQDKEEKNTYIDFIQQIFLKGFIDYLNKNNLKYIESNNNNDN

NDIFSKIKIKKDNKEKYDKILKNYEKHNRNKEIPHEINEFVREIKLGKIL

KYTENLNMFYLILKLLNHKELTNLKGSLEKYQSANKEETFSDELELINLL

NLDNNRVTEDFELEANEIGKFLDFNENKIKDRKELKKFDTNKIYFDGENI

IKHRAFYNIKKYGMLNLLEKIADKAKYKISLKELKEYSNKKNEIEKNYTM

QQNLHRKYARPKKDEKFNDEDYKEYEKAIGNIQKYTHLKNKVEFNELNLL

QGLLLKILHRLVGYTSIWERDLRFRLKGEFPENHYIEEIFNFDNSKNVKY

KSGQIVEKYINFYKELYKDNVEKRSIYSDKKVKKLKQEKKDLYIRNYIAH

FNYIPHAEISLLEVLENLRKLLSYDRKLKNAIMKSIVDILKEYGFVATFK

IGADKKIEIQTLESEKIVHLKNLKKKKLMTDRNSEELCELVKVMFEYKAL

E,

In some embodiments of any of the aspects, the Cas13a comprises the sequence of SEQ ID NO: 2167 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 2167 that maintains the same function (e.g., sequence-specific cleavage of target nucleic acid and/or collateral nucleic acid) or a functional fragment thereof. In some embodiments of any of the aspects, the Cas13a comprises the sequence of SEQ ID NO: 2167 or a sequence that is at least 85% identical to SEQ ID NO: 2167 that maintains the same function. In some embodiments of any of the aspects, the Cas13a comprises the sequence of SEQ ID NO: 2167 or a sequence that is at least 95% identical to SEQ ID NO: 2167 that maintains the same function.

```
CRISPR-associated endoribonuclease Cas13a.
Leptotrichia wadei (strain F0279), UniProtKB -
U2PSH1 (CS13A_LEPWF), 1182 aa NCBI Reference
Sequence: WP_021746774.1
                                  SEQ ID NO: 2167
```
MYMKITKIDGVSHYKKQDKGILKKKWKDLDERKQREKIEARYNKQIESKIY

KEFFRLKNKKRIEKEEDQNIKSLYFFIKELYLNEKNEEWELKNINLEILDD

KERVIKGYKFKEDVYFFKEGYKEYYLRILFNNLIEKVQNENREKVRKNKEF

LDLKEIFKKYKNRKIDLLLKSINNNKINLEYKKENVNEEIYGINPTNDREM

TFYELLKEIIEKKDEQKSILEEKLDNFDITNFLENIEKIFNEETEINIIKG

KVLNELREYIKEKEENNSDNKLKQIYNLELKKYIENNFSYKKQKSKSKNGK

NDYLYLNFLKKIMFIEEVDEKKEINKEKFKNKINSNFKNLFVQHILDYGKL

LYYKENDEYIKNTGQLETKDLEYIKTKETLIRKMAVLVSFAANSYYNLFGR

VSGDILGTEVVKSSKTNVIKVGSHIFKEKMLNYFFDFEIFDANKIVEILES

ISYSIYNVRNGVGHFNKLILGKYKKKDINTNKRIEEDLNNNEEIKGYFIKK

RGEIERKVKEKFLNNLQYYYSKEKIENYFEVYEFEILKRKIPFAPNFKRII

KKGEDLFNNKNNKKYEYFKNFDKNSAEEKKEFLKTRNFLLKELYYNNFYKE

FLSKKEEFEKIVLEVKEEKKSRGNINNKKSGVSFQSIDDYDTKINISDYIA

SIHKKEMERVEKYNEEKQKDTAKYIRDFVEEIFLTGFINYLEKDKRLHFLK

EEFSILCNNNNNVVDFNININEEKIKEFLKENDSKTLNLYLFFNMIDSKRI

SEFRNELVKYKQFTKKRLDEEKEFLGIKIELYETLIEFVILTREKLDTKKS

EEIDAWLVDKLYVKDSNEYKEYEEILKLFVDEKILSSKEAPYYATDNKTPI

LLSNFEKTRKYGTQSFLSEIQSNYKYSKVEKENIEDYNKKEEIEQKKKSNI

EKLQDLKVELHKKWEQNKITEKEIEKYNNTTRKINEYNYLKNKEELQNVYL

LHEMLSDLLARNVAFFNKWERDFKFIVIAIKQFLRENDKEKVNEFLNPPDN

SKGKKVYFSVSKYKNTVENIDGIHKNFMNLIFLNNKFMNRKIDKMNCAIWV

YFRNYIAHFLHLHTKNEKISLISQMNLLIKLFSYDKKVQNHILKSTKTLLE

KYNIQINFEISNDKNEVFKYKIKNRLYSKKGKMLGKNNKFEILENEFLENV

Figure 22:
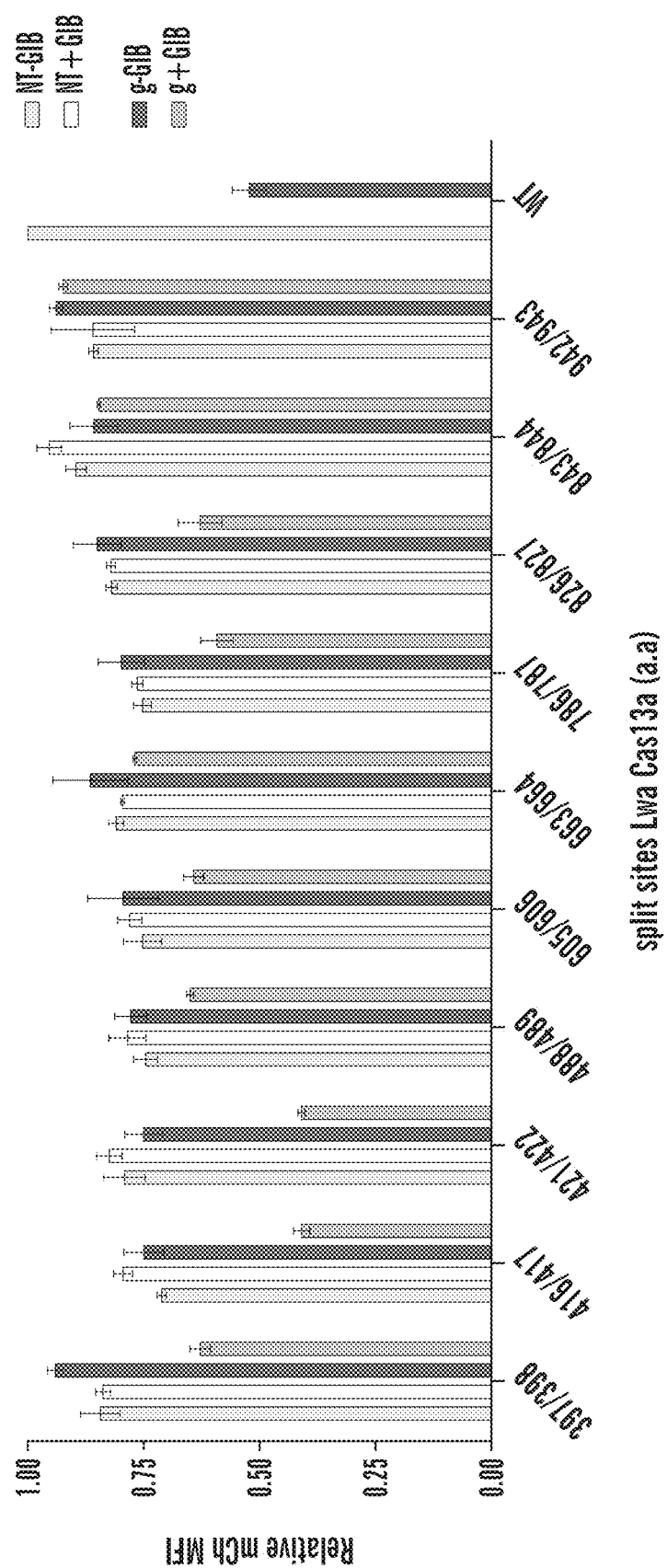
FIG. 22 is a bar graph showing screening of LwaCas13a splits with the GIB inducible systems. mCherry MFI was normalized by iRFP expression in each sample, and then the normalized mCherry/iRFP MFI ratio was then normalized to that of the WTCas13a with non-target crRNA group. The left-right order of the bars for each split site is the same as the top-down order of the legend for the bar graph. "NT" indicates non-target guide RNA. "g" indicates guide RNA. "GIB" indicates gibberellin.

KAMLEYSE,

In some embodiments of any of the aspects, the first ($N^1$) and second ($N^2$) nuclease polypeptide fragments are Cas13a endonuclease polypeptide fragments (see e.g., FIG. 22). In some embodiments of any of the aspects, $N^1$ comprises a N-terminal polypeptide fragment of SEQ ID NO: 2 with the C-terminus ending at amino acid 397 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 398 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 416 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 417 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 421 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 422 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 488 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 489 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 605 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 606 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 663 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 664 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 786 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 787 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 826 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 827 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 831 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 832 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 843 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 844 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, $N^1$ comprises a N-terminal polypeptide fragment of SEQ ID NO: 2 with the C-terminus ending at amino acid 942 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2. In some embodiments of any of the aspects, $N^2$ comprises a C-terminal polypeptide fragment of SEQ ID NO: 2 with the N-terminus beginning at amino acid 943 of SEQ ID NO: 2 or a polypeptide that is at least 70%, at least 80%, at least 85%, at least 90%, at least 95%, at least 96%, at least 97%, at least 98%, or at least 99% identical to SEQ ID NO: 2.

In some embodiments of any of the aspects, the Cas13 endonuclease is Cas13b. In some embodiments of any of the aspects, the Cas endonuclease is derived from the *Prevotella* sp. P5-125 Cas13b (PspCas13b). PspCas13b has demonstrated 90-95% knockdown efficiency using a luciferase reporter; see e.g., Cox et al. (2017) Science 358(6366). In some embodiments of any of the aspects, the Cas13b comprises the sequence of SEQ ID NO: 3 or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to SEQ ID NO: 3 that maintains the same function (e.g., sequence-specific cleavage of target nucleic acid and/or collateral nucleic acid) or a functional fragment thereof. In some embodiments of any of the aspects, the Cas13b comprises the sequence of SEQ ID NO: 3 or a sequence that is at least 85% identical to SEQ ID NO: 3 that maintains the same function. In some embodiments of any of the aspects, the Cas13b comprises the sequence of SEQ ID NO: 3 or a sequence that is at least 95% identical to SEQ ID NO: 3 that maintains the same function.

```
type VI-B CRISPR-associated RNA-guided ribonuclease
Cas13b Prevotella pectinovora, NCBI Reference
Sequence: WP_044065294.1, 1089 aa
                                            SEQ ID NO: 3
MNIPALVENQKKYFGTYSVMAMLNAQTVLDHIQKVADIEGEQNENNENLWF

HPVMSHLYNAKNGYDKQPEKTMFIIERLQSYFPFLKIMAENQREYSNGKYK

QNRVEVNSNDIFEVLKRAFGVLKMYRDLTNHYKTYEEKLNDGCEFLTSTEQ

PLSGMINNYYTVALRNMNERYGYKTEDLAFIQDKRFKFVKDAYGKKKSQVN

TGFFLSLQDYNGDTQKKLHLSGVGIALLICLFLDKQYINIFLSRLPIFSSY

NAQSEERRIIIRSFGINSIKLPKDRIHSEKSNKSVAMDMLNEVKRCPDELF

TTLSAEKQSRFRIISDDHNEVLMKRSSDRFVPLLLQYIDYGKLFDHIRFHV

NMGKLRYLLKADKTCIDGQTRVRVIEQPLNGFGRLEEAETMRKQENGTFGN

SGIRIRDFENMKRDDANPANYPYIVDTYTHYILENNKVEMFINDKEDSAPL

LPVIEDDRYVVKTIPSCRMSTLEIPAMAFHMFLFGSKKTEKLIVDVHNRYK

RLFQAMQKEEVTAENIASFGIAESDLPQKILDLISGNAHGKDVDAFIRLTV

DDMLTDTERRIKRFKDDRKSIRSADNKMGKRGFKQISTGKLADFLAKDIVL

FQPSVNDGENKITGLNYRIMQSAIAVYDSGDDYEAKQQFKLMFEKARLIGK

GTTEPHPFLYKVFARSIPANAVEFYERYLIERKFYLTGLSNEIKKGNRVDV
```

-continued

PFIRRDQNKWKTPAMKTLGRIYSEDLPVELPRQMFDNEIKSHLKSLPQMEG

IDFNNANVTYLIAEYMKRVLDDDFQTFYQWNRNYRYMDMLKGEYDRKGSLQ

HCFTSVEEREGLWKERASRTERYRKQASNKIRSNRQMRNASSEEIETILDK

RLSNSRNEYQKSEKVIRRYRVQDALLFLLAKKTLTELADFDGERFKLKEIM

PDAEKGILSEIMPMSFTFEKGGKKYTITSEGMKLKNYGDFFVLASDKRIGN

LLELVGSDIVSKEDIMEEFNKYDQCRPEISSIVFNLEKWAFDTYPELSARV

DREEKVDFKSILKILLNNKNINKEQSDILRKIRNAFDHNNYPDKGVVEIKA

Figure 21A:
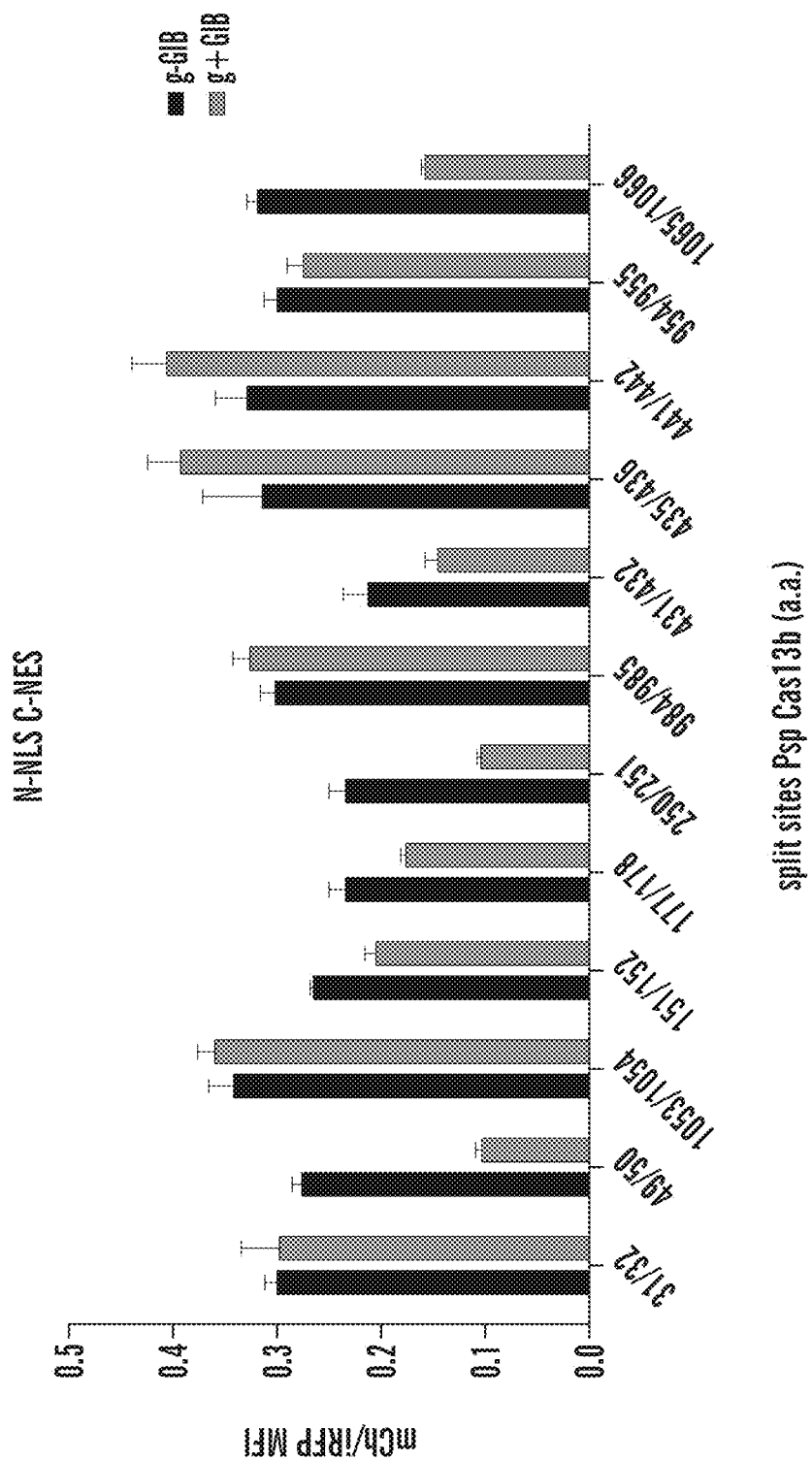
FIG. 21A-21B is a series of bar graphs showing screening of PspCas13b splits with the GIB inducible system. Split PspCas13b coupled with the GIB CIDs were transfected with mCherry targeting crRNAs, along with mCherry as the target gene, and iRFP as a transfection marker. mCherry MFI was normalized by iRFP MFI to eliminate variation generated in the transfection process. GIB inducible PspCas13b split 49/50, 177/178, 250/251, 431/432, and 1065/1066 knocked down mCherry expression by 60% to 20%. Two localization settings were tested for the split pieces: NLS on the N-split and NES on the corresponding C-split (FIG. 21A), or NES on the N-split and NES on the corresponding C-split (FIG. 21B). "g−GIB" indicates guide RNA without gibberellin (GIB). "g+GIB" indicates guide RNA with gibberellin (GIB).
Figure 21B:
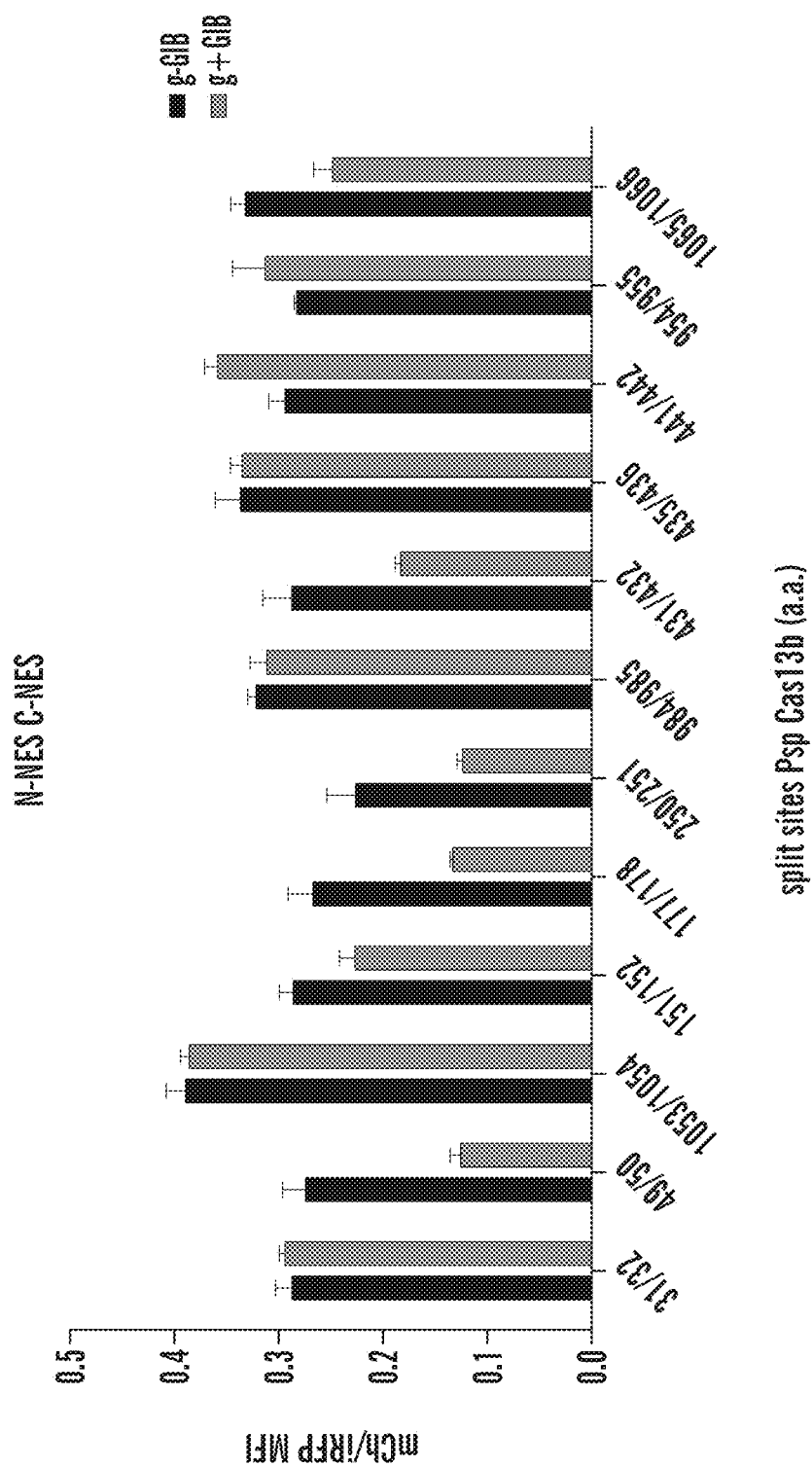

LPEIAMSIKKAFGEYAIMK,

In some embodiments of any of the aspects, the first ($N^1$) and second ($N^2$) nuclease polypeptide fragments are Cas13b endonuclease polypeptide fragments (see e.g., FIG. 21A-21B). In some embodiments of any of the aspects, $N^1$ comprises a N-terminal polypeptide fragment of SEQ ID NO: 3 with the C-terminus ending at amino acid 31 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 32 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 49 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 50 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 1053 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 1054 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 151 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 152 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 177 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 178 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 250 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 251 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 984 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 985 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 431 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 432 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 435 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 436 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 441 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 442 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 954 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 955 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In some embodiments of any of the aspects, $N^1$ comprises a N-terminal polypeptide fragment of SEQ ID NO: 3 with the C-terminus ending at amino acid 1065 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3. In some embodiments of any of the aspects, $N^2$ comprises a C-terminal polypeptide fragment of SEQ ID NO: 3 with the N-terminus beginning at amino acid 1066 of SEQ ID NO: 3 or a polypeptide that is at least 70%, at least 80%, at least 85%, at least 90%, at least 95%, at least 96%, at least 97%, at least 98%, or at least 99% identical to SEQ ID NO: 3.

In several aspects, described herein are polypeptides comprising at least a fragment of a recombinase. In some embodiments of any of the aspects, a recombinase polypeptide system collectively (i.e., the first polypeptide and/or the second polypeptide) comprises two complementary fragments of a recombinase that can combine to form an active recombinase protein. Recombinases, herein, also referred to as "site-specific recombinases" (or "SSR") have been engineered to be very active in a wide range of organisms, including bacteria, mammals, insects, plants and fish. Cre. Fp and PhiC, in particular, have been used widely in animal model development, with Cre being widely used in generation of animal models. However, Cre has demonstrated cytotoxicity, whereas Flp recombinase is very active in mammalian cells and has less toxicity than Cre.

The split-recombinase fragments of the polypeptide systems described herein can be any recombinase polypeptide which associate when brought in to close proximity to generate an active recombinase protein. For example, the two split recombinase proteins can re-associate to generate an active protein. Furthermore, the split-recombinase proteins are designed so that they are in the active state and primed (i.e. in a ready-state) for reconstitution of the active protein in order to minimize any lag time that is traditionally seen with protein complementation in vitro and in vivo.

In some embodiments, a recombinase protein is split into at least two, or at least 3 or more split-recombinase polypeptide fragments. As an exemplary embodiment, a recombinase protein is split into an N-terminal fragment (typically referred to herein as a "a first polypeptide fragment of a recombinase ($R^1$)" or "first recombinase polypeptide fragment") and a C-terminal fragment (typically referred to herein as a "a second polypeptide fragment of a recombinase ($R^2$)" or "second recombinase polypeptide fragment"). In some embodiments of any of the aspects, at least one of the recombinase fragments are conjugated or attached, either directly (e.g., peptide bonds, covalent bonds or cross-linkers), or indirectly (e.g., with peptide linkers and the like) to one member of an inducible dimerization domain, one member of repressible dimerization domain, a sequestering domain, or at least a portion of a sequence-specific nuclease, as described further herein. The present technology is advantageous over existing methods to control recombinase activity, in that it can be inducible by a drug or inducer agent, and does not rely on gene expression, and therefore, works in a variety of different types of cells (prokaryotes, eukaryotes), as well as a cell-free system.

Split-recombinase polypeptide fragments as disclosed herein can be any polypeptide fragments of a recombinase protein which associate when brought in to close proximity to generate the active recombinase protein. That is, the split-recombinase polypeptide fragments by themselves are not active, it is only when they come together by protein complementation, to generate the active recombinase enzyme. In one embodiment of the technology described herein, the methods and compositions encompass the design of split-recombinase polypeptide fragments so that they are active immediately upon their reconstitution. In some embodiments, the split-recombinase polypeptide fragments are designed so that they are in the active state and primed (i.e. in a ready-state) for reconstitution of the active protein in order to minimize any lag time that is traditionally seen with protein complementation in vitro and in vivo.

In some embodiments, the recombinase polypeptide fragments are self-complementing fragments of the recombinase protein. Separately, the recombinase polypeptide fragments do not display the recombinase biological activity, but when physically proximate (e.g., by coming together of the attached dimerization domains; induction of the sequestering domain; presence of a guide nucleic acid specifically bound by a nuclease domain) the fragments spontaneously complement, thereby reconstituting the recombinase protein from which they were derived, restoring the recombinase phenotype. Complementary sets of such fragments are termed "split-recombinase" protein systems. These systems may be generated from any recombinase protein, e.g., Cre, PhiC31, Vcre and B3 recombinases, and variants thereof. The split-recombinase system can be used for genetic circuits, such as those disclosed in WO 2015/188191, as well as other uses are envisioned. Also encompassed in the present invention are split recombinase polypeptides, also referred to as a bi-molecular conjugate, produced by the methods described herein.

Recombinase proteins are split at location S where the N-terminal fragment of the protein is from amino acid 1 to amino acid S (inclusive) and the C-terminal fragment of the protein is from S+1 to the end of the protein.

The technology disclosed herein relates to splitting recombinase proteins into fragments, which are inactive by themselves, but when in close proximity recombine by protein complementation to result in an active recombinase protein. Recombinases are frequently used to impart stable, DNA-base memory to the logic and memory systems in genetic logic circuits. A "recombinase," as used herein, is a site-specific enzyme that recognizes short DNA sequence(s), which sequence(s) are typically between about 30 base pairs (bp) and 40 bp, and that mediates the recombination between these recombinase recognition sequences, which results in the excision, integration, inversion, or exchange of DNA fragments between the recombinase recognition sequences. A "genetic element," as used herein, refers to a sequence of DNA that has a role in gene expression. For example, a promoter, a transcriptional terminator, and a nucleic acid encoding a product (e.g., a protein product) is each considered to be a genetic element.

Recombinases can be classified into two distinct families: serine recombinases (e.g., resolvases and invertases) and tyrosine recombinases (e.g., integrases), based on distinct biochemical properties. Serine recombinases and tyrosine recombinases are further divided into bidirectional recombinases and unidirectional recombinases. Examples of bidirectional serine recombinases include, without limitation, β-six, CinH, ParA and γδ; and examples of unidirectional serine recombinases include, without limitation, Bxb1, φC31 (phiC31), TP901, TG1, φBT1, R4, cpRV1, cpFC1, MRU, A118, U153 and gp29. Examples of bidirectional tyrosine recombinases include, without limitation, Cre, FLP, and R; and unidirectional tyrosine recombinases include, without limitation, Lambda, HK101, HK022 and pSAM2. The serine and tyrosine recombinase names stem from the conserved nucleophilic amino acid residue that the recombinase uses to attack the DNA and which becomes covalently linked to the DNA during strand exchange. Recombinases have been used for numerous standard biological applications, including the creation of gene knockouts and the solving of sorting problems.

Exemplary recombinases for use in the methods and compositions as described herein, and which can be split into two or more protein fragments according to the technology as disclosed herein, include, but are not limited to, Flp, Dre, SCre, VCre, Vika, B2, B3, KD, φC31, Bxb1, λ, HK022, HP1, γδ, ParA, Tn3, Gin, R4, TP901-1, TG1, PhiRv1, PhiBT1, SprA, XisF, TnpX, R, BxB1, A118, spoIVCA, PhiMR11, SCCmec, TndX, XerC, XerD, XisA, Hin, Cin, mrpA, beta, PhiFC1, Fre, Clp, sTre, FimE, and HbiF.

The outcome of the recombination reaction mediated by coming together of split-recombinase polypeptide fragment depends, in part, on the location and orientation of two short repeated DNA sequences (e.g., RRS) that are to be recombined, typically less than 30 bp long. Recombinases bind to these repeated sequences, which are specific to each recombinase, and are herein referred to as "recombinase recognition sequences" or "recombinase recognition sites" or "RRS". Thus, as used herein, a recombinase is "specific for" a recombinase recognition site when the recombinase can mediate inversion or excision between the repeat DNA sequences. As used herein, a recombinase may also be said to recognize its "cognate recombinase recognition sites," which flank an intervening genetic element (e.g., promoter, terminator, or target gene). A genetic element is said to be "flanked" by recombinase recognition sites when the element is located between and immediately adjacent to two repeated DNA sequences. In some embodiments, the recombinase recognition sites do not overlap each other. However, in other embodiments, recombinase recognition sites do overlap each other, such as described herein below, which permits greatly increased combinatorial complexity.

Exemplary RRS include, but are not limited to, loxP, loxN, lox 511, lox 5171, lox 2272, M2, M3, M7, M11, lox71, lox66, FRT, rox, SloxM1, VloxP, vox, B3RT, KDRT, F3, F14, attB/P, F5, F13, Vlox2272, Slox2272, SloxP, RSRT, and B2RT.

In some embodiments, a recombinase which can be split into two or more protein fragments according to the technology as disclosed herein, can result in an inversion reaction. Inversion recombination happens between two short, inverted, repeated DNA sequences. Without wishing to be bound by theory, a DNA loop formation, assisted by DNA bending proteins, brings the two repeat sequences together, at which point DNA cleavage and ligation occur. This reaction is ATP-independent and requires supercoiled DNA. The end result of such an inversion recombination event is that the stretch of DNA between the repeated site inverts (i.e., the stretch of DNA reverses orientation) such that what was the coding strand is now the non-coding strand and vice versa. In such reactions, the DNA is conserved with no net gain or no loss of DNA.

In some embodiments, a recombinase which can be split into two or more protein fragments according to the technology as disclosed herein, can results in an excision reaction. Conversely, excision (integration) recombination occurs between two short, repeated DNA sequences that are oriented in the same direction. In this case, the intervening DNA is excised/removed. For example, an AND gate can be assembled by placing a terminator between each of two different sets of recombinase sites oriented for excision, flanked by a promoter and an output, such as a GFP-encoding sequence. In this example, both terminators must be excised by input-dependent action of the recombinase(s) to permit read through from the promoter to the GFP-encoding sequence. Thus two inputs are needed to excise both terminators to generate output.

In some embodiments, a recombinase for splitting and use in the present invention is an orthogonal recombinase. In a genetic circuit when a first recombinase is orthogonal to the second recombinase, it means that the second recombinase does not recognize the RRS specific for the first recombinase, neither does the first recombinase recognize the RRS specific for the second recombinase.

In some embodiments, a recombinase which can be split into two or more protein fragments according to the technology as disclosed herein, can also be an irreversible or reversible recombinase. As used herein, an "irreversible recombinase" refers to a recombinase that can catalyze recombination between two complementary recombination sites, but cannot catalyze recombination between the hybrid sites that are formed by this recombination without the assistance of an additional factor. Thus, an "irreversible recognition site" refers to a recombinase recognition site that can serve as the first of two DNA recognition sequences for an irreversible recombinase and that is modified to a hybrid recognition site following recombination at that site. A "complementary irreversible recognition site" refers to a recombinase recognition site that can serve as the second of two DNA recognition sequences for an irreversible recombinase and that is modified to a hybrid recombination site following homologous recombination at that site. For example, attB and attP, described below, are the irreversible recombination sites for Bxb1 and phiC31 recombinases—attB is the complementary irreversible recombination site of attP, and vice versa. The attB/attP sites can be mutated to create orthogonal B/P pairs that only interact with each other but not the other mutants. This allows a single recombinase to control the excision or integration or inversion of multiple orthogonal B/P pairs.

In some embodiments, a recombinase which can be split into two or more recombinase polypeptide fragments according to the technology as disclosed herein is the phiC31 (C31) integrase. The phiC31 integrase, for example, catalyzes only the attB×attP reaction in the absence of an additional factor not found in eukaryotic cells. The recombinase cannot mediate recombination between the attL and attR hybrid recombination sites that are formed upon recombination between attB and attP. Because recombinases such as the phiC31 integrase cannot alone catalyze the reverse reaction, the phiC31 attB×attP recombination is stable.

Irreversible recombinases, and nucleic acids that encode the irreversible recombinases, are described in the art and can be obtained using routine methods. Examples of irreversible recombinases include, without limitation, phiC31

(φC31) recombinase, coliphage P4 recombinase, coliphage lambda integrase, *Listeria* A118 phage recombinase, and actinophage R4 Sre recombinase, HK101, HK022, pSAM2, Bxb1, TP901, TGI, φBTI, cpRV1, cpFC1, MRU, U153 and gp29. Conversely, a "reversible recombinase" refers to a recombinase that can catalyze recombination between two complementary recombinase recognition sites and, without the assistance of an additional factor, can catalyze recombination between the sites that are formed by the initial recombination event, thereby reversing it. The product-sites generated by recombination are themselves substrates for subsequent recombination. Examples of reversible recombinase systems include, without limitation, the Cre-lox and the Flp-frt systems, R, β-six, CinH, ParA and γδ.

The recombinases provided herein for splitting into two or more recombinase polypeptide fragments are not meant to be exclusive examples of recombinases that can be used in embodiments of the invention. Other examples of recombinases that can be split into two or more recombinase polypeptide fragments that are useful in the technology as described herein are known to those of skill in the art, and any new recombinase that is discovered or generated is expected to be able to be used in the different embodiments of the invention.

In some embodiments, a recombinase which can be split into two or more recombinase polypeptide fragments according to the technology as disclosed herein is a serine recombinase. Thus, in some embodiments, the recombinase is considered to be irreversible. For some serine recombinases, an initial recombination event can be reversed when a recombinase directionality factor (RDF) is present. RDFs are a diverse group of proteins involved in controlling the directionality of integrase-mediated site-specific recombination reactions. Typically, RDFs are small DNA-binding proteins acting as accessory factors to influence the choice of substrates that are recombined by their cognate recombinase. See Lewis and Hatfull, Nucleic Acids Res. 2001 Jun. 1; 29(11): 2205-2216. For example, when the recombination sites, attB and attP are placed in the antiparallel orientation, the presence of recombinases can stably invert the DNA sequence between the two sites and generate an attL and attR site ("BP reaction"). This inversion remains stable unless a RDF is also expressed along with bxb1 or phiC, which can invert the sequence between attL and attR and regenerate attB and attP site ("LR reaction"). Examples of RDF include, but are not limited to, gp47 for bxb1, gp3 for phiC31, gp3 for PhiBT1, ORF7 for TP901-1, gp25 for TG1, and gp3 for PhiRv1.

In some embodiments, a recombinase which can be split into two or more recombinase polypeptide fragments according to the technology as disclosed herein is a tyrosine recombinase. Thus, in some embodiments, the recombinase is considered to be reversible.

In some embodiments, a recombinase which can be split into two or more recombinase polypeptide fragments according to the technology as disclosed herein is Cre and the corresponding recombinase recognition sequences comprise loxP.

In some embodiments, a recombinase which can be split into two or more recombinase polypeptide fragments according to the technology as disclosed herein is Flp and the corresponding recombinase recognition sequences comprise FRT.

In some embodiments, a recombinase which can be split into two or more recombinase polypeptide fragments according to the technology as disclosed herein is phiC31 (C31) recombinase and the corresponding recombinase recognition sequences comprise phiC31attB and phiC31 attP, to yield product sites attL and attR, respectively.

In some embodiments, a recombinase which can be split into two or more recombinase polypeptide fragments according to the technology as disclosed herein is VCre and the corresponding recombinase recognition sequences comprise VloxP.

In some embodiments, a recombinase which can be split into two or more recombinase polypeptide fragments according to the technology as disclosed herein is B3 and the corresponding recombinase recognition sequences comprise B3RT.

In some embodiments, a recombinase which can be split into two or more recombinase polypeptide fragments according to the technology as disclosed herein is BxB1 recombinase, and the corresponding recombinase recognition sequences are Bxb1 attB and Bxb1 attP to yield product sites attL and attR, respectively.

In some embodiments, a recombinase which can be split into two or more recombinase polypeptide fragments according to the technology as disclosed herein is Dre and the corresponding recombinase recognition sequences comprise rox.

In some embodiments, a recombinase which can be split into two or more recombinase polypeptide fragments according to the technology as disclosed herein is SCre and the corresponding recombinase recognition sequences comprise SloxM1.

In some embodiments, a recombinase which can be split into two or more recombinase polypeptide fragments according to the technology as disclosed herein is Vika and the corresponding recombinase recognition sequences comprise vox.

In some embodiments, a recombinase which can be split into two or more recombinase polypeptide fragments according to the technology as disclosed herein is KD and the corresponding recombinase recognition sequences comprise KDRT.

In some embodiments, the split-recombinase is a Cre recombinase. In some embodiments, a split-recombinase protein comprises at least two, or at least three, or at least 4 recombinase polypeptide fragments from the Cre protein of SEQ ID NO: 58, where when the fragments can complement and reconstitute to generate an active Cre recombinase protein. In the avoidance of any doubt, SEQ ID NO: 58 is as follows:

```
                                  (SEQ ID NO: 58)
MSNLLTVHQNLPALPVDATSDEVRKNLMDMFRDRQAFSEHTWKMLLSVCRS

WAAWCKLNNRKWFPAEPEDVRDYLLYLQARGLAVKTIQQHLGQLNMLHRRS

GLPRPSDSNAVSLVMRRIRKENVDAGERAKQALAFERTDFDQVRSLMENSD

RCQDIRNLAFLGIAYNTLLRIAEIARIRVKDISRTDGGRMLIHIGRTKTLV

STAGVEKALSLGVTKLVERWISVSGVADDPNNYLFCRVRKNGVAAPSATSQ

LSTRALEGIFEATHRLIYGAKDDSGQRYLAWSGHSARVGAARDMARAGVSI

PEIMQAGGWTNVNIVMNYIRNLDSETGAMVRLLEDGD
```

In some embodiments, a split-recombinase protein comprises at least two, or at least three, or at least 4 recombinase polypeptide fragments from an amino acid sequence that is at least 75%, or at least 80%, or at least 85%, or at least 90% or at least 95%, or at least about 97%, or at least about 98%, or at least about 99% identical to SEQ ID NO: 58, where when the recombinase polypeptide fragments can complement and reconstitute to generate an active Cre recombinase protein.

In some embodiments, a recombinase which can be split into two or more recombinase polypeptide fragments according to the technology as disclosed herein is Cre recombinase, which, when reconstituted from its inactive polypeptide fragments, recognizes the loxP recombinase recognition sequences. Accordingly, in some embodiments, an active reconstituted Cre protein from the protein complementation of 2 or more recombinase polypeptide fragments can recognize loxP sites, and results in site-specific recombination of a nucleic acid sequence between two such loxP sites.

Accordingly, in some embodiments, a recombinase which can be split into two or more recombinase polypeptide fragments according to the technology as disclosed herein is Cre, and when the two recombinase polypeptide fragments come together, they generate the active Cre recombinase protein which can recognize RRS comprising LoxP. A LoxP sequence can comprise nucleic acids ATAACTTCGTA-TAnnntannmTATACGAAGTTAT (SEQ ID NO: 59).

In some embodiments, Cre can be split into at least two, or at least 3 or more split-recombinase polypeptide fragments. As an exemplary embodiment, Cre recombinase protein is split into an N-terminal fragment and a C-terminal fragment, where the N-terminal and C-terminal fragments are conjugated or attached, either directly (e.g., peptide bonds, covalent bonds or cross-linkers), or indirectly (e.g., with peptide linkers and the like) to another domain as described herein, e.g., one portion of an inducible dimerization domain, one portion of a repressible dimerization domain, a sequestering domain, or at least a portion of a nuclease. In presence of an inducer agent or inducer signal for such a domain, the N- and C-terminal Cre recombinase polypeptide fragments are brought into close proximity with each other allowing protein complementation to occur and the generation of the active Cre recombinase protein, which can bind to the LoxP sequence of SEQ ID NO: 59.

Cre recombinase can be split at location S where the N-terminal VCre polypeptide fragment is from amino acid 1 to amino acid S (inclusive) and the C-terminal VCre polypeptide fragment of the protein is from S+1 to the end of the protein. In some embodiments, a N-terminal Cre recombinase polypeptide fragment comprises a continuous stretch of amino acids of a fragment of the N-terminal of SEQ ID NO: 58, where the C-terminus of such a N-terminal Cre fragment ends at amino acid of 229, 251, 256, or 270 of SEQ ID NO: 58, or the equivalent amino acid of a protein of at least 70% sequence homology to SEQ ID NO: 58. In some embodiments, a C-terminal Cre recombinase polypeptide fragment comprises a continuous stretch of amino acids of a fragment of the C-terminal of SEQ ID NO: 16, where the N-terminus of such a C-terminal Cre fragment begins at amino acid of 230, 252, 257, or 271 of SEQ ID NO: 58, or the equivalent amino acid of a protein of at least 70% sequence homology to SEQ ID NO: 58. In some embodiments, exemplary N-terminal Cre recombinase polypeptide fragments and exemplary C-terminal Cre recombinase polypeptides are disclosed in Table 3.

TABLE 3

Exemplary Cre recombinase polypeptide fragments

| Split-Cre recombinase | N-terminal fragment (aa of SEQ ID NO: 58) | C-terminal fragment (aa of SEQ ID NO: 58) |
| --- | --- | --- |
| 229/230 | 1-229 (Cre 229N) | 230-342 (Cre C230) |
| 251/252 | 1-251 (Cre 251N) | 252-342 (Cre C230) |
| 256/257 | 1-256 (Cre 256N) | 256-342 (Cre C230) |
| 270/271 | 1-270 (Cre 270N) | 270-342 (Cre C230) |

In some embodiments of any of the aspects, $R^1$ comprises a N-terminal polypeptide fragment of SEQ ID NO: 58 with the C-terminus ending at amino acid 229 of SEQ ID NO: 58 or a polypeptide that is at least 70%, at least 80%, at least 85%, at least 90%, at least 95%, at least 96%, at least 97%, at least 98%, or at least 99% identical to SEQ ID NO: 58. In some embodiments of any of the aspects, $R^2$ comprises a C-terminal polypeptide fragment of SEQ ID NO: 58 with the N-terminus beginning at amino acid 230 of SEQ ID NO: 58 or a polypeptide that is at least 70%, at least 80%, at least 85%, at least 90%, at least 95%, at least 96%, at least 97%, at least 98%, or at least 99% identical to SEQ ID NO: 58.

In some embodiments of any of the aspects, $R^1$ comprises a N-terminal polypeptide fragment of SEQ ID NO: 58 with the C-terminus ending at amino acid 251 of SEQ ID NO: 58 or a polypeptide that is at least 70%, at least 80%, at least 85%, at least 90%, at least 95%, at least 96%, at least 97%, at least 98%, or at least 99% identical to SEQ ID NO: 58. In some embodiments of any of the aspects, $R^2$ comprises a C-terminal polypeptide fragment of SEQ ID NO: 58 with the N-terminus beginning at amino acid 252 of SEQ ID NO: 58 or a polypeptide that is at least 70%, at least 80%, at least 85%, at least 90%, at least 95%, at least 96%, at least 97%, at least 98%, or at least 99% identical to SEQ ID NO: 58.

In some embodiments of any of the aspects, $R^1$ comprises a N-terminal polypeptide fragment of SEQ ID NO: 58 with the C-terminus ending at amino acid 256 of SEQ ID NO: 58 or a polypeptide that is at least 70%, at least 80%, at least 85%, at least 90%, at least 95%, at least 96%, at least 97%, at least 98%, or at least 99% identical to SEQ ID NO: 58. In some embodiments of any of the aspects, $R^2$ comprises a C-terminal polypeptide fragment of SEQ ID NO: 58 with the N-terminus beginning at amino acid 257 of SEQ ID NO: 58 or a polypeptide that is at least 70%, at least 80%, at least 85%, at least 90%, at least 95%, at least 96%, at least 97%, at least 98%, or at least 99% identical to SEQ ID NO: 58.

In some embodiments of any of the aspects, $R^1$ comprises a N-terminal polypeptide fragment of SEQ ID NO: 58 with the C-terminus ending at amino acid 270 of SEQ ID NO: 58 or a polypeptide that is at least 70%, at least 80%, at least 85%, at least 90%, at least 95%, at least 96%, at least 97%, at least 98%, or at least 99% identical to SEQ ID NO: 58. In some embodiments of any of the aspects, $R^2$ comprises a C-terminal polypeptide fragment of SEQ ID NO: 58 with the N-terminus beginning at amino acid 271 of SEQ ID NO: 58 or a polypeptide that is at least 70%, at least 80%, at least 85%, at least 90%, at least 95%, at least 96%, at least 97%, at least 98%, or at least 99% identical to SEQ ID NO: 58.

In some embodiments, the split-recombinase is a Flp or FlpO recombinase. In some embodiments, a split-recombinase protein comprises at least two, or at least three, or at least 4 recombinase polypeptide fragments from the FlpO protein of SEQ ID NO: 60, where when the fragments can complement and reconstitute to generate an active Flp recombinase protein. In the avoidance of any doubt, SEQ ID NO: 60 is as follows:

(SEQ ID NO: 60)
MSQFDILCKTPPKVLVRQFVERFERPSGEKIASCAAELTYLCWMITHNGTA

IKRATFMSYNTIISNSLSFDIVNKSLQFKYKTQKATILEASLKKLIPAWEF

TIIPYNGQKHQSDITDIVSSLQLQFESSEEADKGNSHSKKMLKALLSEGES

IWEITEKILNSFEYTSRFTKTKTLYQFLFLATFINCGRFSDIKNVDPKSFK

LVQNKYLGVIIQCLVTETKTSVSRHIYFFSARGRIDPLVYLDEFLRNSEPV

LKRVNRTGNSSSNKQEYQLLKDNLVRSYNKALKKNAPYPIFAIKNGPKSHI

GRHLMTSFLSMKGLTELTNVVGNWSDKRASAVARTTYTHQITAIPDHYFAL

VSRYYAYDPISKEMIALKDETNPIEEWQHIEQLKGSAEGSIRYPAWNGIIS

QEVLDYLSSYINRRI

In some embodiments, a split-recombinase protein comprises at least two, or at least three, or at least 4 recombinase polypeptide fragments from an amino acid sequence that is at least 75%, or at least 80%, or at least 85%, or at least 90% or at least 95%, or at least about 97%, or at least about 98%, or at least about 99% identical to SEQ ID NO: 60, where when the recombinase polypeptide fragments can complement and reconstitute to generate an active Flp recombinase protein.

An active reconstituted Flp protein from the protein complementation of 2 or more recombinase polypeptide fragments can recognize flippase recognition target (FRT) sites, and results in site-specific recombination of a nucleic acid sequence between two such FRT sites.

Accordingly, in some embodiments, a recombinase which can be split into two or more recombinase polypeptide fragments according to the technology as disclosed herein is Flp, and when the two recombinase polypeptide fragments come together, they generate the active Flp recombinase protein which can recognize recombinase recognition sequences comprise FRT. A FRT sequence can comprise nucleic acids (SEQ ID NO: 61)
GAAGTTCCTATTCTCTAGAAAGTATAGGAACTTC.

In some embodiments, Flp can be split into at least two, or at least 3 or more split-recombinase polypeptide fragments. As an exemplary embodiment, Flp recombinase protein is split into an N-terminal fragment and a C-terminal fragment, where the N-terminal and C-terminal fragments are conjugated or attached, either directly (e.g., peptide bonds, covalent bonds or cross-linkers), or indirectly (e.g., with peptide linkers and the like) to another domain as described herein, e.g., one portion of an inducible dimerization domain, one portion of a repressible dimerization domain, a sequestering domain, or at least a portion of a nuclease. In presence of an inducer agent or inducer signal for such a domain, the N- and C-terminal Flp recombinase polypeptide fragments are brought into close proximity with each other allowing protein complementation to occur and the generation of the active Flp recombinase protein, which can bind to FRT sequence of SEQ ID NO: 61.

Flp recombinase can be split at location S where the N-terminal Flp polypeptide fragment is from amino acid 1 to amino acid S (inclusive) and the C-terminal Flp polypeptide fragment of the protein is from S+1 to the end of the protein. In some embodiments, a N-terminal Flp recombinase polypeptide fragment comprises a continuous stretch of amino acids of a fragment of the N-terminal of SEQ ID NO: 60, where the C-terminus of such a N-terminal Flp fragment ends at amino acid of 27, 49, 74, 81, 160, 112, 132, 150, 168, 234, 249, 257, 264, 275, 290, 301, 349, 374, 392, 396 of SEQ ID NO: 60, or the equivalent amino acid of a protein of at least 70% sequence homology to SEQ ID NO: 60. In some embodiments, a C-terminal Flp recombinase polypeptide fragment comprises a continuous stretch of amino acids of a fragment of the C-terminal of SEQ ID NO: 60, where the N-terminus of such a C-terminal Flp fragment begins at amino acid of 28, 40, 75, 82, 161, 113, 133, 151, 169, 235, 250, 258, 265, 276, 291, 302, 350, 375, 393, 397 of SEQ ID NO: 60, or the equivalent amino acid of a protein of at least 70% sequence homology to SEQ ID NO: 60. In some embodiments, exemplary N-terminal Flp recombinase polypeptide fragments and exemplary C-terminal Flp recombinase polypeptides are disclosed in Table 4.

TABLE 4

Exemplary Flp recombinase polypeptide fragments

| Split-Flp recombinase | Split-Flp recombinase fragments (N- and C-terminal fragments) | |
|---|---|---|
| | N-terminal fragment (aa of SEQ ID NO: 60) | C-terminal fragment (aa of SEQ ID NO: 60) |
| Flp1 | 1-27 (Flp1-N) | 28-423 (Flp1-C) |
| Flp2 | 1-168 (Flp2-N) | 169-423 (Flp2-C) |
| Flp3 | 1-374 (Flp3-N) | 375-423 (Flp3-C) |
| Flp4 | 1-396 (Flp4-N) | 397-423 (Flp4-C) |

Flp1-N: In some embodiments, a N-terminal Flp recombinase polypeptide fragment comprises a continuous stretch of amino acids of a fragment of the N-terminal of SEQ ID NO: 60, where the C-terminus of such a N-terminal Flp fragment ends at amino acid 27 of SEQ ID NO: 60 (such a Flp polypeptide fragment is herein referred to "Flp1-N"). In some embodiments, a N-terminal Flp recombinase polypeptide fragment comprise amino acids 1-27 of SEQ ID NO: 60 or a polypeptide of at least 70%, or 80% or 85% or 90%, or 95% or 97% or 98% or 99% identity to amino acids 1-27 of SEQ ID NO: 60. In some embodiments, a N-terminal Flp recombinase polypeptide fragment comprises a C-terminal fragment amino acids 1-27 of SEQ ID NO: 60, for example, but by no way a limitation, where at least 1, 2, 3, 4, 5, 6, 7, 8, 9, 10, or more than 10 amino acids are missing from the N-terminal of amino acids 1-27 of SEQ ID NO: 60.

Flp2-N: In some embodiments, a N-terminal Flp recombinase polypeptide fragment comprises a continuous stretch of amino acids of a fragment of the N-terminal of SEQ ID NO: 60, where the C-terminus of such a N-terminal Flp fragment ends at amino acid 168 of SEQ ID NO: 60 (such a Flp polypeptide fragment is herein referred to "Flp2-N"). In some embodiments, a N-terminal Flp recombinase polypeptide fragment comprise amino acids of amino acids 1-168 of SEQ ID NO: 60 or a polypeptide of at least 70%, or 80% or 85% or 90%, or 95% or 97% or 98% or 99% identity to amino acids 1-168 of SEQ ID NO: 60. In some embodiments, a N-terminal Flp recombinase polypeptide fragment comprises a C-terminal fragment of amino acids 1-168 of SEQ ID NO: 60, for example, but by no way a limitation, where at least 1, 2, 3, 4, 5, 6, 7, 8, 9, 10, between 10-20, between 20-30, between 10-50, or more than 50 amino acids are missing from the N-terminal of amino acids 1-168 of SEQ ID NO: 60.

Flp3-N: In some embodiments, a N-terminal Flp recombinase polypeptide fragment comprises a continuous stretch of amino acids of a fragment of the N-terminal of SEQ ID NO: 60, where the C-terminus of such a N-terminal Flp fragment ends at amino acid 374 of SEQ ID NO: 60 (such a Flp polypeptide fragment is herein referred to "Flp3-N"). In some embodiments, a N-terminal Flp recombinase polypeptide fragment comprises amino acids 1-374 of SEQ ID NO: 60 or a polypeptide of at least 70%, or 80% or 85% or 90%, or 95% or 97% or 98% or 99% identity to amino acids 1-374 of SEQ ID NO: 60. In some embodiments, a N-terminal Flp recombinase polypeptide fragment comprises a C-terminal fragment of amino acids 1-374 of SEQ ID NO: 60, for example, but by no way a limitation, where at least 1, 2, 3, 4, 5, 6, 7, 8, 9, 10, between 10-20, between 20-30, between 10-50, or more than 50 amino acids are missing from the N-terminal of amino acids 1-374 of SEQ ID NO: 60.

Flp4-N: In some embodiments, a N-terminal Flp recombinase polypeptide fragment comprises a continuous stretch of amino acids of a fragment of the N-terminal of SEQ ID NO: 60, where the C-terminus of such a N-terminal Flp fragment ends at amino acid 396 of SEQ ID NO: 60 (such a Flp polypeptide fragment is herein referred to "Flp4-N"). In some embodiments, a N-terminal Flp recombinase polypeptide fragment comprise amino acids 1-396 of SEQ ID NO: 60 or a polypeptide of at least 70%, or 80% or 85% or 90%, or 95% or 97% or 98% or 99% identity to amino acids 1-396 of SEQ ID NO: 60. In some embodiments, a N-terminal Flp recombinase polypeptide fragment comprises a C-terminal fragment of amino acids 1-396 of SEQ ID NO: 60, for example, but by no way a limitation, where at least 1, 2, 3, 4, 5, 6, 7, 8, 9, 10, between 10-20, between 20-30, between 10-50, or more than 50 amino acids are missing from the N-terminal of amino acids 1-396 of SEQ ID NO: 60.

In some embodiments, a cysteine may be added to the C-terminal of a N-terminal Flp polypeptide fragment, or polypeptides of at least 70% identity thereto, or C-terminal fragments thereof, in order to aid its conjugation to a domain as described herein.

Flp1-C: In some embodiments, a C-terminal Flp recombinase polypeptide fragment comprises a continuous stretch of amino acids of a fragment of the C-terminal of SEQ ID NO: 60, where the N-terminus of such a C-terminal Flp fragment begins at amino acid 28 of SEQ ID NO: 60 (such a Flp polypeptide fragment is herein referred to "Flp1-C"). In some embodiments, a C-terminal Flp recombinase polypeptide fragment comprise amino acids 28-423 of SEQ ID NO: 60 or a polypeptide of at least 70%, or 80% or 85% or 90%, or 95% or 97% or 98% or 99% identity to amino acids 28-423 of SEQ ID NO: 60. In some embodiments, a C-terminal Flp recombinase polypeptide fragment comprises a N-terminal fragment of amino acids 28-423 of SEQ ID NO: 60, for example, but by no way a limitation, where at least 1, 2, 3, 4, 5, 6, 7, 8, 9, 10, between 10-20, between 20-30, between 10-50, or more than 50 amino acids are missing from the C-terminal of amino acids 28-423 of SEQ ID NO: 60.

Flp2-C: In some embodiments, a C-terminal Flp recombinase polypeptide fragment comprises a continuous stretch of amino acids of a fragment of the C-terminal of SEQ ID NO: 60, where the N-terminus of such a C-terminal Flp fragment begins at amino acid 169 of SEQ ID NO: 60 (such a Flp polypeptide fragment is herein referred to "Flp2-C"). In some embodiments, a C-terminal Flp recombinase polypeptide fragment comprise amino acids 169-423 of SEQ ID NO: 60 or a polypeptide of at least 70%, or 80% or 85% or 90%, or 95% or 97% or 98% or 99% identity to amino acids 169-423 of SEQ ID NO: 60. In some embodiments, a C-terminal Flp recombinase polypeptide fragment comprises a N-terminal fragment of amino acids 169-423 of SEQ ID NO: 60, for example, but by no way a limitation, where at least 1, 2, 3, 4, 5, 6, 7, 8, 9, 10, between 10-20, between 20-30, between 10-50, or more than 50 amino acids are missing from the C-terminal of amino acids 169-423 of SEQ ID NO: 60.

Flp3-C: In some embodiments, a C-terminal Flp recombinase polypeptide fragment comprises a continuous stretch of amino acids of a fragment of the C-terminal of SEQ ID NO: 60, where the N-terminus of such a C-terminal Flp fragment begins at amino acid 375 of SEQ ID NO: 60 (such a Flp polypeptide fragment is herein referred to "Flp3-C"). In some embodiments, a C-terminal Flp recombinase polypeptide fragment comprise amino acids 375-423 of SEQ ID NO: 60 or a polypeptide of at least 70%, or 80% or 85% or 90%, or 95% or 97% or 98% or 99% identity to amino acids 375-423 of SEQ ID NO: 60. In some embodiments, a C-terminal Flp recombinase polypeptide fragment comprises a N-terminal fragment of amino acids 375-423 of SEQ ID NO: 60, for example, but by no way a limitation, where at least 1, 2, 3, 4, 5, 6, 7, 8, 9, 10, between 10-20, between 20-30, or more than 30 amino acids are missing from the C-terminal of amino acids 375-423 of SEQ ID NO: 60.

Flp4-C: In some embodiments, a C-terminal Flp recombinase polypeptide fragment comprises a continuous stretch of amino acids of a fragment of the C-terminal of SEQ ID NO: 60, where the N-terminus of such a C-terminal Flp fragment begins at amino acid 397 of SEQ ID NO: 60 (such a Flp polypeptide fragment is herein referred to "Flp4-C"). In some embodiments, a C-terminal Flp recombinase polypeptide fragment comprise amino acids 397-423 of SEQ ID NO: 60 or a polypeptide of at least 70%, or 80% or 85% or 90%, or 95% or 97% or 98% or 99% identity to amino acids 397-423 of SEQ ID NO: 60. In some embodiments, a C-terminal Flp recombinase polypeptide fragment comprises a N-terminal fragment of amino acids 397-423 of SEQ ID NO: 60, for example, but by no way a limitation, where at least 1, 2, 3, 4, 5, 6, 7, 8, 9, 10, 15, or more than 15 amino acids are missing from the C-terminal of amino acids 397-423 of SEQ ID NO: 60.

In some embodiments, a cysteine may be added to the N-terminal of a C-terminal Flp polypeptide fragment, or polypeptides of at least 70% identity thereto, or N-terminal fragments thereof, in order to aid conjugation to a domain as described herein.

In some embodiments, a N-terminal Flp polypeptide fragment is inactive by itself and cannot recognize or bind to FRT, but results in an active Flp recombinase protein which can recognize FRT of SEQ ID NO: 61 when it is in close proximity to, and reconstitutes (or protein complements) with its cognate C-terminal Flp polypeptide fragment.

As disclosed herein, a recombinase can be split into three or more fragments, therefore requiring two inducer agents for full recombinase rejoinder and reconstitution. Using Flp as an exemplary embodiment, Flp can be split into three fragments, i.e., $Flp^A$, $Flp^B$ and $Flp^C$, where $Flp^A$ can be, for example, Flp1-N (i.e., amino acids 1-27 of Flp), $Flp^B$ can be, for example, amino acids 28-396 of Flp, and $Flp^C$ can be, for example, amino acids 397-423 of Flp (i.e., Flp4-C).

In some embodiments, in a three-Flp split system, requiring 2 inducers for reconstitution of the active Flp recombinase protein, exemplary N-terminal Flp recombinase polypeptide fragments, exemplary middle Flp fragments and exemplary C-terminal Flp recombinase polypeptides are disclosed in Table 5. In some embodiments, the split Flp can be split into the following fragments; aa 1-27/aa 28-168/aa 169-423; aa 1-27/aa 28-374/aa 375-423; aa 1-27/aa 28-396/aa 397-423; aa 1-168/aa 169-374/aa 375-423; aa 1-168/aa 169-396/aa 397-423; and aa 1-374/aa 375-396/aa 397-423 of SEQ ID NO: 60, or fragments of at least 75%, or 80% or 85%, or 90%, or 95% or 98% identity to aa 1-27/aa 28-168/aa 169-423; aa 1-27/aa 28-374/aa 375-423; aa 1-27/aa 28-396/aa 397-423; aa 1-168/aa 169-374/aa 375-423; aa 1-168/aa 169-396/aa 397-423; and aa 1-374/aa 375-396/aa 397-423 of SEQ ID NO: 60.

TABLE 5

Exemplary 3-split Flp recombinase polypeptide fragments.

| 3-part split Flp recombinase | Flp$^A$ (N-terminal fragment) | Flp$^B$ Middle fragment) | Flp$^C$ (C-terminal fragment) |
|---|---|---|---|
| Flp(1-28-169) | aa 1-27 | aa 28-168 | aa 169-423 |
| Flp(1-28-375) | aa 1-27 | aa 28-374 | aa 375-423 |
| Flp(1-28-397) | aa 1-27 | aa 28-396 | aa 397-423 |
| Flp(1-169-375) | aa 1-168 | aa 169-374 | aa 375-423 |
| Flp(1-169-397) | aa 1-168 | aa 169-396 | aa 397-423 |
| Flp(1-375-397) | aa 1-374 | aa 375-396 | aa 397-423 |

Split-Flp recombinase fragments (shown as aa of SEQ ID NO: 1)

In some embodiments, the split-recombinase is a PhiC31 recombinase. In some embodiments, a split-recombinase protein comprises at least two, or at least three, or at least 4 recombinase polypeptide fragments from the PhiC31 protein of SEQ ID NO: 62, where when the fragments can complement and reconstitute to generate an active PhiC31 recombinase protein. In the avoidance of any doubt, SEQ ID NO: 62 is as follows:

(SEQ ID NO: 62)
MDTYAGAYDRQSRERENSSAASPATQRSANEDKAADLQREVERDGGRFRFV

GHFSEAPGTSAFGTAERPEFERILNECRAGRLNMIIVYDVSRFSRLKVMDA

IPIVSELLALGVTIVSTQEGVFRQGNVMDLIHLIMRLDASHKESSLKSAKI

LDTKNLQRELGGYVGGKAPYGFELVSETKEITRNGRMVNVVINKLAHSTTP

LTGPFEFEPDVIRWWWREIKTHKHLPFKPGSQAAIHPGSITGLCKRMDADA

VPTRGETIGKKTASSAWDPATVMRILRDPRIAGFAAEVIYKKKPDGTPTTK

IEGYRIQRDPITLRPVELDCGPIIEPAEWYELQAWLDGRGRGKGLSRGQAI

LSAMDKLYCECGAVMTSKRGEESIKDSYRCRRRKVVDPSAPGQHEGTCNVS

MAALDKFVAERIFNKIRHAEGDEETLALLWEAARRFGKLTEAPEKSGERAN

LVAERADALNALEELYEDRAAGAYDGPVGRKHFRKQQAALTLRQQGAEERL

AELEAAEAPKLPLDQWFPEDADADPTGPKSWWGRASVDDKRVFVGLFVDKI

VVTKSTTGRGQGTPIEKRASITWAKPPTDDDEDDAQDGTEDVAA

In some embodiments, a split-recombinase protein comprises at least two, or at least three, or at least 4 recombinase polypeptide fragments from an amino acid sequence that is at least 75%, or at least 80%, or at least 85%, or at least 90% or at least 95%, or at least about 97%, or at least about 98%, or at least about 99% identical to SEQ ID NO: 62, where when the recombinase polypeptide fragments can complement and reconstitute to generate an active PhiC31 (φC31) integrase protein.

The phiC31 integrase, for example, catalyzes only the attB×attP reaction in the absence of an additional factor that is not found in eukaryotic cells. However, once recombination of attB×attP has occurred, the recombinase cannot mediate recombination between the resulting attL and attR hybrid recombination sites (the recombination sites that are formed upon recombination between attB and attP). As such, because phiC31 integrase cannot alone catalyze the reverse reaction, the phiC31 attB×attP recombination is stable (i.e., irreversible).

In some embodiments, a recombinase which can be split into two or more recombinase polypeptide fragments according to the technology as disclosed herein is phiC31 (φC31) recombinase and the corresponding recombinase recognition sequences comprise phiC31 attB and phiC31 attP. Accordingly, in some embodiments, an active reconstituted PhiC31 protein from the protein complementation of 2 or more recombinase polypeptide fragments can recognize attB or attP sites, and results in site-specific recombination of a nucleic acid sequence between two such attB and attP sites.

Accordingly, in some embodiments, a recombinase which can be split into two or more recombinase polypeptide fragments according to the technology as disclosed herein is PhiC31, and when the two recombinase polypeptide fragments come together, they generate the active PhiC31 recombinase protein which can recognize RRS comprising attB and attP. A PhiC31 attB sequence can comprise nucleic acids TGCGGGTGCCAGGGCGTGCCCTTGGGCTCCCCGG GCGCGTACTCC (SEQ ID NO: 63), and a PhiC31 attP sequence can comprise nucleic acids (SEQ ID NO: 64)
GTGCCCCAACTGGGGTAACCTTTGAGTTCTCTCAGTTGGGGG.

In some embodiments, PhiC31 can be split into at least two, or at least 3 or more split-recombinase polypeptide fragments. As an exemplary embodiment, PhiC31 recombinase protein is split into an N-terminal fragment and a C-terminal fragment, where the N-terminal and C-terminal fragments are conjugated or attached, either directly (e.g., peptide bonds, covalent bonds or cross-linkers), or indirectly (e.g., with peptide linkers and the like) to another domain as described herein, e.g., one portion of an inducible dimerization domain, one portion of a repressible dimerization domain, a sequestering domain, or at least a portion of a nuclease. In presence of an inducer agent or inducer signal for such a domain, the N- and C-terminal PhiC31 recombinase polypeptide fragments are brought into close proximity with each other allowing protein complementation to occur and the generation of the active PhiC31 recombinase protein, which can bind to attB and attP sequences of SEQ ID NO: 63 and SEQ ID NO: 64.

PhiC31 recombinase can be split at location S where the N-terminal PhiC31 polypeptide fragment is from amino acid 1 to amino acid S (inclusive) and the C-terminal PhiC31 polypeptide fragment of the protein is from S+1 to the end of the protein. In some embodiments, a N-terminal PhiC31 recombinase polypeptide fragment comprises a continuous stretch of amino acids of a fragment of the N-terminal of SEQ ID NO: 62, where the C-terminus of such a N-terminal PhiC31 fragment ends at amino acid of 233, 300, 314, 349, 379, 396, 428, 571 of SEQ ID NO: 62, or the equivalent amino acid of a protein of at least 70% sequence homology to SEQ ID NO: 62. In some embodiments, a C-terminal PhiC31 recombinase polypeptide fragment comprises a continuous stretch of amino acids of a fragment of the C-terminal of SEQ ID NO: 62, where the N-terminus of such a C-terminal PhiC31 fragment begins at amino acid of 234, 301, 315, 350, 380, 397, 429, 572 of SEQ ID NO: 62, or the equivalent amino acid of a protein of at least 70% sequence homology to SEQ ID NO: 62. In some embodiments, exemplary N-terminal PhiC31 recombinase polypeptide fragments and exemplary C-terminal PhiC31 recombinase polypeptides are disclosed in Table 5.

TABLE 5

Exemplary PhiC31 recombinase polypeptide fragments in a two-split PhiC31 system

| Split-PhiC31 recombinase | N-terminal fragment (aa of SEQ ID NO: 62) | C-terminal fragment (aa of SEQ ID NO: 62) |
| --- | --- | --- |
| PhiC31-1 | 1-233 (PhiC31-1-N) | 234-605 (PhiC31-1-C) |
| PhiC31-2 | 1-396 (PhiC31-2-N) | 397-605 (PhiC31-2-C) |
| PhiC31-3 | 1-428 (PhiC31-3-N) | 429-605 (PhiC31-3-C) |
| PhiC31-4 | 1-571 (PhiC31-4-N) | 572-605 (PhiC31-4-C) |

As discussed above, recombinases can be split into three or more fragments. For example, in some embodiments, exemplary 3-split recombinase systems of PhiC31 are shown in Table 6.

TABLE 6

Exempary 3-split PhiC31 recombinase polypeptide fragments.

| 3-part split PhiC31 recombinase | Split- PhiC31 recombinase fragments (shown as aa of SEQ ID NO: 62) | | |
| --- | --- | --- | --- |
| | PhiC31$^A$ (N-terminal fragment) | PhiC31$^B$ (Middle fragment) | PhiC31$^C$ (C-terminal fragment) |
| PhiC31(1-234-397) | aa 1-233 | aa 234-396 | aa 397-605 |
| PhiC31(1-234-429) | aa 1-233 | aa 234-428 | aa 429-605 |
| PhiC31(1-234-572) | aa 1-233 | aa 234-571 | aa 572-605 |
| PhiC31(1-396-429) | aa 1-396 | aa 397-428 | aa 429-605 |
| PhiC31(1-396-572) | aa 1-396 | aa 397-571 | aa 572-605 |
| PhiC31(1-429-572) | aa 1-428 | aa 429-571 | aa 572-605 |

In some embodiments, a N-terminal PhiC31 recombinase polypeptide fragment comprises a continuous stretch of amino acids of a fragment of the N-terminal of SEQ ID NO: 62, where the C-terminus of such a N-terminal PhiC31 fragment ends at aa 233, or 396, or 428 or 571 of SEQ ID NO: 62, or a polypeptide of at least 70%, or 80% or 85% or 90%, or 95% or 97% or 98% or 99% identity to SEQ ID NO: 62. In such embodiments, a C-terminal PhiC31 recombinase polypeptide fragment comprises a continuous stretch of amino acids of a fragment of the C-terminal of SEQ ID NO: 62, where the N-terminus of such a C-terminal PhiC31 fragment begins at amino acids 234, or 397, or 429 or 572 of SEQ ID NO: 62, or a polypeptide of at least 70%, or 80% or 85% or 90%, or 95% or 97% or 98% or 99% identity to SEQ ID NO: 62.

In some embodiments of any of the aspects, $R^1$ comprises a N-terminal polypeptide fragment of SEQ ID NO: 62 with the C-terminus ending at amino acid 233 of SEQ ID NO: 62 or a polypeptide that is at least 70%, at least 80%, at least 85%, at least 90%, at least 95%, at least 96%, at least 97%, at least 98%, or at least 99% identical to SEQ ID NO: 62. In some embodiments of any of the aspects, $R^2$ comprises a C-terminal polypeptide fragment of SEQ ID NO: 62 with the N-terminus beginning at amino acid 234 of SEQ ID NO: 62 or a polypeptide that is at least 70%, at least 80%, at least 85%, at least 90%, at least 95%, at least 96%, at least 97%, at least 98%, or at least 99% identical to SEQ ID NO: 62.

In some embodiments of any of the aspects, $R^1$ comprises a N-terminal polypeptide fragment of SEQ ID NO: 62 with the C-terminus ending at amino acid 396 of SEQ ID NO: 62 or a polypeptide that is at least 70%, at least 80%, at least 85%, at least 90%, at least 95%, at least 96%, at least 97%, at least 98%, or at least 99% identical to SEQ ID NO: 62. In some embodiments of any of the aspects, $R^2$ comprises a C-terminal polypeptide fragment of SEQ ID NO: 62 with the N-terminus beginning at amino acid 397 of SEQ ID NO: 62 or a polypeptide that is at least 70%, at least 80%, at least 85%, at least 90%, at least 95%, at least 96%, at least 97%, at least 98%, or at least 99% identical to SEQ ID NO: 62.

In some embodiments of any of the aspects, $R^1$ comprises a N-terminal polypeptide fragment of SEQ ID NO: 62 with the C-terminus ending at amino acid 428 of SEQ ID NO: 62 or a polypeptide that is at least 70%, at least 80%, at least 85%, at least 90%, at least 95%, at least 96%, at least 97%, at least 98%, or at least 99% identical to SEQ ID NO: 62. In some embodiments of any of the aspects, $R^2$ comprises a C-terminal polypeptide fragment of SEQ ID NO: 62 with the N-terminus beginning at amino acid 429 of SEQ ID NO: 62 or a polypeptide that is at least 70%, at least 80%, at least 85%, at least 90%, at least 95%, at least 96%, at least 97%, at least 98%, or at least 99% identical to SEQ ID NO: 62.

In some embodiments of any of the aspects, $R^1$ comprises a N-terminal polypeptide fragment of SEQ ID NO: 62 with the C-terminus ending at amino acid 571 of SEQ ID NO: 62 or a polypeptide that is at least 70%, at least 80%, at least 85%, at least 90%, at least 95%, at least 96%, at least 97%, at least 98%, or at least 99% identical to SEQ ID NO: 62. In some embodiments of any of the aspects, $R^2$ comprises a C-terminal polypeptide fragment of SEQ ID NO: 62 with the N-terminus beginning at amino acid 572 of SEQ ID NO: 62 or a polypeptide that is at least 70%, at least 80%, at least 85%, at least 90%, at least 95%, at least 96%, at least 97%, at least 98%, or at least 99% identical to SEQ ID NO: 62.

In some embodiments, a N-terminal PhiC31 recombinase polypeptide fragment comprises a continuous stretch of amino acids of a fragment of the N-terminal of SEQ ID NO: 62, where the C-terminus of such a N-terminal PhiC31 fragment ends anywhere between amino acids 20-30, or 31-40, or 41-50, or 51-60, or 61-70, or 71-80, or 81-90, or 91-100 of SEQ ID NO: 62, or a polypeptide of at least 70%, or 80% or 85% or 90%, or 95% or 97% or 98% or 99% identity to SEQ ID NO: 62. In such embodiments, a C-terminal PhiC31 recombinase polypeptide fragment comprises a continuous stretch of amino acids of a fragment of the C-terminal of SEQ ID NO: 62, where the N-terminus of such a C-terminal PhiC31 fragment begins anywhere between amino acids 21-31, or 32-41, or 42-51, or 52-61, or 62-72, or 72-81, or 82-91, or 91-101 of SEQ ID NO: 62, or a polypeptide of at least 70%, or 80% or 85% or 90%, or 95% or 97% or 98% or 99% identity to SEQ ID NO: 62.

In some embodiments, a N-terminal PhiC31 recombinase polypeptide fragment comprises a continuous stretch of amino acids of a fragment of the N-terminal of SEQ ID NO: 62, where the C-terminus of such a N-terminal PhiC31 fragment ends anywhere between amino acids 101-150, or 151-200, or 201-250, or 251-300, or 301-350, or 351-400, or 451-500 of SEQ ID NO: 62, or a polypeptide of at least 70%, or 80% or 85% or 90%, or 95% or 97% or 98% or 99% identity to SEQ ID NO: 62. In such embodiments, a C-terminal PhiC31 recombinase polypeptide fragment comprises a continuous stretch of amino acids of a fragment of the C-terminal of SEQ ID NO: 62, where the N-terminus of such a C-terminal PhiC31 fragment begins anywhere between amino acids 102-151, or 152-201, or 202-251, or 252-301, or 302-351, or 352-401, or 452-501 of SEQ ID NO: 62, or a polypeptide of at least 70%, or 80% or 85% or 90%, or 95% or 97% or 98% or 99% identity to SEQ ID NO: 62.

In some embodiments, a N-terminal PhiC31 recombinase polypeptide fragment comprises a continuous stretch of amino acids of a fragment of the N-terminal of SEQ ID NO: 62, where the C-terminus of such a N-terminal PhiC31 fragment ends anywhere between amino acids 501-510, or 511-520, or 521-530, or 531-540, or 541-550, or 551-560, or 561-570, or 571-580, or 581-590, or 591-600, or 601-603 of SEQ ID NO: 62, or a polypeptide of at least 70% or 80% or 85% or 90%, or 95% or 97% or 98% or 99% identity to SEQ ID NO: 62. In such embodiments, a C-terminal PhiC31 recombinase polypeptide fragment comprises a continuous stretch of amino acids of a fragment of the C-terminal of SEQ ID NO: 62, where the N-terminus of such a C-terminal PhiC31 fragment begins anywhere between amino acids 502-511, or 512-521, or 522-531, or 532-541, or 542-551, or 552-561, or 562-571, or 572-581, or 582-591, or 592-601, or 602-604 of SEQ ID NO: 62, or a polypeptide of at least 70%, or 80% or 85% or 90%, or 95% or 97% or 98% or 99% identity to SEQ ID NO: 62.

In some embodiments, the split-recombinase is a VCre recombinase. In some embodiments, a split-recombinase protein comprises at least two, or at least three, or at least 4 recombinase polypeptide fragments from the VCre protein of SEQ ID NO: 65, where when the fragments can complement and reconstitute to generate an active VCre recombinase protein. In the avoidance of any doubt, SEQ ID NO: 65 is as follows:

(SEQ ID NO: 65)
MIENQLSLLGDFSGVRPDDVKTAIQAAQKKGINVAENEQFKAAFEHLLNEF

KKREERYSPNTLRRLESAWTCFVDWCLANHRHSLPATPDTVEAFFIERAEE

LHRNTLSVYRWAISRVHRVAGCPDPCLDIYVEDRLKAIARKKVREGEAVKQ

ASPFNEQHLLKLTSLWYRSDKLLLRRNLALLAVAYESMLRASELANIRVSD

MELAGDGTAILTIPITKTNHSGEPDTCILSQDVVSLLMDYTEAGKLDMSSD

GFLFVGVSKHNTCIKPKKDKQTGEVLHKPITTKTVEGVFYSAWETLDLGRQ

GVKPFTAHSARVGAAQDLLKKGYNTLQIQQSGRWSSGAMVARYGRAILARD

GAMAHSRVKTRSAPMQWGKDEKD

In some embodiments, a split-recombinase protein comprises at least two, or at least three, or at least 4 recombinase polypeptide fragments from an amino acid sequence that is at least 75%, or at least 80%, or at least 85%, or at least 90% or at least 95%, or at least about 97%, or at least about 98%, or at least about 99% identical to SEQ ID NO: 65, where when the recombinase polypeptide fragments can complement and reconstitute to generate an active VCre recombinase protein.

In some embodiments, a recombinase which can be split into two or more recombinase polypeptide fragments according to the technology as disclosed herein is VCre recombinase, which, when reconstituted from its inactive polypeptide fragments, recognizes the VloxP recombinase recognition sequences. Accordingly, in some embodiments, an active reconstituted VCre protein from the protein complementation of 2 or more recombinase polypeptide fragments can recognize VloxP sites, and results in site-specific recombination of a nucleic acid sequence between two such VloxP sites.

Accordingly, in some embodiments, a recombinase which can be split into two or more recombinase polypeptide fragments according to the technology as disclosed herein is VCre, and when the two recombinase polypeptide fragments come together, they generate the active VCre recombinase protein which can recognize RRS comprising VLoxP. A VLoxP sequence can comprise nucleic acids TCAATTCT-GAGAactgtcatTCTCGGAAATIGA (SEQ ID NO: 66).

In some embodiments, VCre can be split into at least two, or at least 3 or more split-recombinase polypeptide fragments. As an exemplary embodiment, VCre recombinase protein is split into an N-terminal fragment and a C-terminal fragment, where the N-terminal and C-terminal fragments are conjugated or attached, either directly (e.g., peptide bonds, covalent bonds or cross-linkers), or indirectly (e.g., with peptide linkers and the like) to another domain as described herein, e.g., one portion of an inducible dimerization domain, one portion of a repressible dimerization domain, a sequestering domain, or at least a portion of a nuclease. In presence of an inducer agent or inducer signal for such a domain, the N- and C-terminal VCre recombinase polypeptide fragments are brought into close proximity with each other allowing protein complementation to occur and the generation of the active VCre recombinase protein, which can bind to VLoxP sequence of SEQ ID NO: 66.

VCre recombinase can be split at location S where the N-terminal VCre polypeptide fragment is from amino acid 1 to amino acid S (inclusive) and the C-terminal VCre polypeptide fragment of the protein is from S+1 to the end of the protein. In some embodiments, a N-terminal VCre recombinase polypeptide fragment comprises a continuous stretch of amino acids of a fragment of the N-terminal of SEQ ID NO: 65, where the C-terminus of such a N-terminal VCre fragment ends at amino acid of 58, 82, 103, 125, 154, 172, 192, 210, 220, 227, 245, 257, 269, 277, 285, 303, 312, 330 and 366 of SEQ ID NO: 65, or the equivalent amino acid of a protein of at least 70% sequence homology to SEQ ID NO: 65. In some embodiments, a C-terminal VCre recombinase polypeptide fragment comprises a continuous stretch of amino acids of a fragment of the C-terminal of SEQ ID NO: 65, where the N-terminus of such a C-terminal VCre fragment begins at amino acid of 59, 83, 104, 126, 155, 173, 193, 211, 221, 228, 246, 258, 270, 278, 286, 304, 313, 331 and 367 of SEQ ID NO: 65, or the equivalent amino acid of a protein of at least 70% sequence homology to SEQ ID NO: 65. In some embodiments, exemplary N-terminal VCre recombinase polypeptide fragments and exemplary C-terminal VCre recombinase polypeptides are disclosed in Table 7.

TABLE 7

Exemplary VCre recombinase polypeptide fragments

| Split-VCre recombinase | N-terminal fragment (aa of SEQ ID NO: 65) | C-terminal fragment (aa of SEQ ID NO: 65) |
| --- | --- | --- |
| VCre-1 | 1-82 (VCre-1-N) | 83-380 (VCre-1-C) |
| VCre-2 | 1-172 (VCre-2-N) | 173-380 (VCre-2-C) |
| VCre-3 | 1-210 (VCre-3-N) | 211-380 (VCre-3-C) |
| VCre-4 | 1-269 (VCre-4-N) | 270-380 (VCre-4-C) |
| VCre-5 | 1-277 (VCre-5-N) | 278-380 (VCre-5-C) |

As discussed above, recombinases can be split into three or more fragments. For example, in some embodiments, exemplary 3-split recombinase systems of VCre are shown in Table 8. In some embodiments, the split VCre can be split into the following fragments; aa 1-82/83-172/173-380; 1-82/83-269/270-380; 1-82/83-277/278-380; 1-172/173-269/270-380; 1-172/173-277/278-380; and 1-269/270-277/278-380 of SEQ ID NO: 65, or fragments of at least 75%, or 80% or 85%, or 90%, or 95% or 98% identity to aa 11-82/83-172/173-380; 1-82/83-269/270-380; 1-82/83-277/278-380; 1-172/173-269/270-380; 1-172/173-277/278-380; and 1-269/270-277/278-380 of SEQ ID NO: 65.

TABLE 8

Exempary 3-split VCre recombinase polypeptide fragments.

| 3-part split VCre recombinase | Split-VCre recombinase fragments (shown as aa of SEQ ID NO: 65) | | |
|---|---|---|---|
| | $VCre^A$ (N-terminal fragment) | $VCre^B$ (Middle fragment) | $VCre^C$ (C-terminal fragment) |
| VCre (1-83-173) | aa 1-82 | aa 83-172 | aa 173-380 |
| VCre (1-83-270) | aa 1-82 | aa 83-269 | aa 270-380 |
| VCre (1-83-278) | aa 1-82 | aa 83-277 | aa 278-380 |
| VCre (1-173-270) | aa 1-172 | aa 173-269 | aa 270-380 |
| VCre (1-173-278) | aa 1-172 | aa 173-277 | aa 278-380 |
| VCre (1-269-278) | aa 1-269 | aa 270-277 | aa 278-380 |

In some embodiments of any of the aspects, $R^1$ comprises a N-terminal polypeptide fragment of SEQ ID NO: 65 with the C-terminus ending at amino acid 82 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65. In some embodiments of any of the aspects, $R^2$ comprises a C-terminal polypeptide fragment of SEQ ID NO: 65 with the N-terminus beginning at amino acid 83 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65.

In some embodiments of any of the aspects, $R^1$ comprises a N-terminal polypeptide fragment of SEQ ID NO: 65 with the C-terminus ending at amino acid 172 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65. In some embodiments of any of the aspects, $R^2$ comprises a C-terminal polypeptide fragment of SEQ ID NO: 65 with the N-terminus beginning at amino acid 173 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65.

In some embodiments of any of the aspects, $R^1$ comprises a N-terminal polypeptide fragment of SEQ ID NO: 65 with the C-terminus ending at amino acid 210 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65. In some embodiments of any of the aspects, $R^2$ comprises a C-terminal polypeptide fragment of SEQ ID NO: 65 with the N-terminus beginning at amino acid 211 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65.

In some embodiments of any of the aspects, $R^1$ comprises a N-terminal polypeptide fragment of SEQ ID NO: 65 with the C-terminus ending at amino acid 269 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65. In some embodiments of any of the aspects, $R^2$ comprises a C-terminal polypeptide fragment of SEQ ID NO: 65 with the N-terminus beginning at amino acid 270 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65.

In some embodiments of any of the aspects, $R^1$ comprises a N-terminal polypeptide fragment of SEQ ID NO: 65 with the C-terminus ending at amino acid 277 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65. In some embodiments of any of the aspects, $R^2$ comprises a C-terminal polypeptide fragment of SEQ ID NO: 65 with the N-terminus beginning at amino acid 278 of SEQ ID NO: 65 or a polypeptide that is at least 70%, at least 80%, at least 85%, at least 90%, at least 95%, at least 96%, at least 97%, at least 98%, or at least 99% identical to SEQ ID NO: 65.

In some embodiments, a N-terminal VCre recombinase polypeptide fragment comprises a continuous stretch of amino acids of a fragment of the N-terminal of SEQ ID NO: 65, where the C-terminus of such a N-terminal VCre fragment ends anywhere between amino acids 20-30, or 31-40, or 41-50, or 51-60, or 61-70, or 71-80, or 81-90, or 91-100 of SEQ ID NO: 65, or a polypeptide of at least 70%, or 80% or 85% or 90%, or 95% or 97% or 98% or 99% identity to SEQ ID NO: 65. In such embodiments, a C-terminal VCre recombinase polypeptide fragment comprises a continuous stretch of amino acids of a fragment of the C-terminal of SEQ ID NO: 65, where the N-terminus of such a C-terminal VCre fragment begins anywhere between amino acids 21-31, or 32-41, or 42-51, or 52-61, or 62-72, or 72-81, or 82-91, or 91-101 of SEQ ID NO: 65, or a polypeptide of at least 70%, or 80% or 85% or 90%, or 95% or 97% or 98% or 99% identity to SEQ ID NO: 65.

In some embodiments, a N-terminal VCre recombinase polypeptide fragment comprises a continuous stretch of amino acids of a fragment of the N-terminal of SEQ ID NO: 65, where the C-terminus of such a N-terminal VCre fragment ends anywhere between amino acids 101-150, or 151-200, or 201-250 of SEQ ID NO: 65, or a polypeptide of at least 70%, or 80% or 85% or 90%, or 95% or 97% or 98% or 99% identity to SEQ ID NO: 65. In such embodiments, a C-terminal VCre recombinase polypeptide fragment comprises a continuous stretch of amino acids of a fragment of the C-terminal of SEQ ID NO: 65, where the N-terminus of such a C-terminal VCre fragment begins anywhere between amino acids 102-151, or 152-201, or 202-251 of SEQ ID NO: 65, or a polypeptide of at least 70%, or 80% or 85% or 90%, or 95% or 97% or 98% or 99% identity to SEQ ID NO: 65.

In some embodiments, a N-terminal VCre recombinase polypeptide fragment comprises a continuous stretch of amino acids of a fragment of the N-terminal of SEQ ID NO: 65, where the C-terminus of such a N-terminal VCre fragment ends anywhere between amino acids 251-280, or 281-300, or 301-320, or 321-340, or 341-360 of SEQ ID NO: 65, or a polypeptide of at least 70%, or 80% or 85% or 90%, or 95% or 97% or 98% or 99% identity to SEQ ID NO: 65. In such embodiments, a C-terminal VCre recombinase polypeptide fragment comprises a continuous stretch of amino acids of a fragment of the C-terminal of SEQ ID NO: 65, where the N-terminus of such a C-terminal VCre fragment begins anywhere between amino acids 252-281, or 282-301, or 302-321, or 322-341, or 342-361 of SEQ ID NO: 65, or a polypeptide of at least 70%, or 80% or 85% or 90%, or 95% or 97% or 98% or 99% identity to SEQ ID NO: 65.

In some embodiments, the split-recombinase is a B3 recombinase. In some embodiments, a split-recombinase protein comprises at least two, or at least three, or at least 4 recombinase polypeptide fragments from the B3 protein of SEQ ID NO: 67, where when the fragments can complement and reconstitute to generate an active B3 recombinase protein. In the avoidance of any doubt, SEQ ID NO: 67 is as follows:

(SEQ ID NO: 67)
MSSYMDLVDDEPATLYHKFVECLKAGENFCGDKLSGIITMAILKAIKALTE

VKKTTFNKYKTTIKQGLQYDVGSSTISFVYHLKDCDELSRGLSDAFEPYKF

KIKSNKEATSFKTLFRGPSFGSQKNWRKKEVDREVDNLFHSTETDESIFKF

ILNTLDSIETQTNTDRQKTVLTFILLMTFFNCCRNNDLMNVDPSTFKIVKN

KFVGYLLQAEVKQTKTRKSRNIFFFPIRENRFDLFLALHDFFRTCQPTPKS

RLSDQVSEQKWQLFRDSMVIDYNRFFRKFPASPIFAIKHGPKSHLGRHLMN

SFLHKNELDSWANSLGNWSSSQNQRESGARLGYTHGGRDLPQPLFGFLAGY

CVRNEEGHIVGLGLEKDINDLFDGIMDPLNEKEDTEICESYGEWAKIVSKD

VLIFLKRYHSKNACRRYQNSTLYARTFLKTESVTLSGSKGSEEPSSPVRIP

ILSMGKASPSEGRKLRASEHANDDNEIEKIDSDSSQSEEIPIEMSDSEDET

TASNISGIYLDMSKANSNVVYSPPSQTGRAAGAGRKRGVGGRRTVESKRRR

VLAPINR

In some embodiments, a split-recombinase protein comprises at least two, or at least three, or at least 4 recombinase polypeptide fragments from an amino acid sequence that is at least 75%, or at least 80%, or at least 85%, or at least 90% or at least 95%, or at least about 97%, or at least about 98%, or at least about 99% identical to SEQ ID NO: 67, where when the recombinase polypeptide fragments can complement and reconstitute to generate an active B3 recombinase protein.

In some embodiments, a recombinase which can be split into two or more recombinase polypeptide fragments according to the technology as disclosed herein is B3 recombinase, where the active reconstituted protein recognizes RRS of B3RT. Accordingly, in some embodiments, an active reconstituted B3 protein from the protein complementation of 2 or more recombinase polypeptide fragments can recognize attB or attP sites, and results in site-specific recombination of a nucleic acid sequence between two such attB and attP sites.

Accordingly, in some embodiments, a recombinase which can be split into two or more recombinase polypeptide fragments according to the technology as disclosed herein is B3, and when the two recombinase polypeptide fragments come together, they generate the active B3 recombinase protein which can recognize RRS comprising B3RT. A B3 B3RT sequence can comprise nucleic acids (SEQ ID NO: 68)
GGTTGCTTAAGAATAAGTAATTCTTAAGCAACC.

In some embodiments, B3 can be split into at least two, or at least 3 or more split-recombinase polypeptide fragments. As an exemplary embodiment, B3 recombinase protein is split into an N-terminal fragment and a C-terminal fragment, where the N-terminal and C-terminal fragments are conjugated or attached, either directly (e.g., peptide bonds, covalent bonds or cross-linkers), or indirectly (e.g., with peptide linkers and the like) to another domain as described herein, e.g., one portion of an inducible dimerization domain, one portion of a repressible dimerization domain, a sequestering domain, or at least a portion of a nuclease. In presence of an inducer agent or inducer signal for such a domain, the N- and C-terminal B3 recombinase polypeptide fragments are brought into close proximity with each other allowing protein complementation to occur and the generation of the active B3 recombinase protein, which can bind to a B3RT sequence of SEQ ID NO: 68.

B3 recombinase can be split at location S where the N-terminal B3 polypeptide fragment is from amino acid 1 to amino acid S (inclusive) and the C-terminal B3 polypeptide fragment of the protein is from S+1 to the end of the protein. In some embodiments, a N-terminal B3 recombinase polypeptide fragment comprises a continuous stretch of amino acids of a fragment of the N-terminal of SEQ ID NO: 67, where the C-terminus of such a N-terminal B3 fragment ends at amino acid of 27, 49, 74, 84, 106, 122, 146, 164, 206, 220, 230, 234, 250, 254, 259, 285, 345, 378, 394, 403, 428, 439, 504, 512, 527, 539 and 549 of SEQ ID NO: 19, or the equivalent amino acid of a protein of at least 70% sequence homology to SEQ ID NO: 67. In some embodiments, a C-terminal B3 recombinase polypeptide fragment comprises a continuous stretch of amino acids of a fragment of the C-terminal of SEQ ID NO: 67, where the N-terminus of such a C-terminal B3 fragment begins at amino acid of 28, 50, 75, 85, 107, 123, 147, 165, 207, 221, 231, 235, 251, 255, 260, 286, 346, 379, 395, 404, 429, 440, 505, 513, 528, 540 and 550 of SEQ ID NO: 19, or the equivalent amino acid of a protein of at least 70% sequence homology to SEQ ID NO: 67. In some embodiments, exemplary N-terminal B3 recombinase polypeptide fragments and exemplary C-terminal B3 recombinase polypeptides are disclosed in Table 9.

TABLE 9

Exemplary B3 recombinase polypeptide fragments.

| Split-B3 recombinase | N-terminal fragment (aa of SEQ ID NO: 67) | C-terminal fragment (aa of SEQ ID NO: 67) |
| --- | --- | --- |
| B3-A | 1-539 (B3-A-N) | 540-568 |
| B3-1 | 1 and aa 20-100 | 21-101 to 568 |
| B3-2 | 1 and aa 100-300 | 101-301 to 568 |
| B3-3 | 1 and aa 300-400 | 301-401 to 568 |
| B3-4 | 1 and aa 400-550 | 401-551 to 568 |

In some embodiments, a N-terminal B3 recombinase polypeptide fragment comprises a continuous stretch of amino acids of a fragment of the N-terminal of SEQ ID NO: 67, where the C-terminus of such a N-terminal B3 fragment ends anywhere between amino acids 20-30, or 31-40, or 41-50, or 51-60, or 61-70, or 71-80, or 81-90, or 91-100 of SEQ ID NO: 67, or a polypeptide of at least 70%, or 80% or 85% or 90%, or 95% or 97% or 98% or 99% identity to SEQ ID NO: 67. In such embodiments, a cognate C-terminal B3 recombinase polypeptide fragment comprises a continuous stretch of amino acids of a fragment of the C-terminal of SEQ ID NO: 67, where the N-terminus of such a C-terminal B3 fragment begins anywhere between amino acids 21-31, or 32-41, or 42-51, or 52-61, or 62-72, or 72-81, or 82-91, or 91-101 SEQ ID NO: 67, or a polypeptide of at least 70%, or 80% or 85% or 90%, or 95% or 97% or 98% or 99% identity to SEQ ID NO: 67.

In some embodiments, a N-terminal B3 recombinase polypeptide fragment comprises a continuous stretch of amino acids of a fragment of the N-terminal of SEQ ID NO: 67, where the C-terminus of such a N-terminal B3 fragment ends anywhere between amino acids 101-150, or 151-200, or 201-250, or 251-300, or 301-350, or 351-400 of SEQ ID NO: 67, or a polypeptide of at least 700, or 80% or 85% or 90%, or 95% or 97% or 98% or 99% identity to SEQ ID NO: 67. In such embodiments, a C-terminal B3 recombinase polypeptide fragment comprises a continuous stretch of amino acids of a fragment of the C-terminal of SEQ ID NO: 67, where the N-terminus of such a C-terminal B3 fragment begins anywhere between amino acids 102-151, or 152-201, or 202-251, or 252-301, or 302-351, or 352-401 of SEQ ID NO: 67, or a polypeptide of at least 70%, or 80% or 85% or 90%, or 95% or 97% or 98% or 99% identity SEQ ID NO: 67.

In some embodiments, a N-terminal B3 recombinase polypeptide fragment comprises a continuous stretch of amino acids of a fragment of the N-terminal of SEQ ID NO: 67, where the C-terminus of such a N-terminal B3 fragment ends anywhere between amino acids 401-420-, or 421-440, or 441-460, or 461-480, or 481-500, or 501-510, or 511-520, or 521-530, or 531-540, or 541-550, or 551-560 of SEQ ID NO: 67, or a polypeptide of at least 70%, or 80% or 85% or 90%, or 95% or 97% or 98% or 99% identity to SEQ ID NO: 67. In such embodiments, a cognate C-terminal B3 recombinase polypeptide fragment comprises a continuous stretch of amino acids of a fragment of the C-terminal of SEQ ID NO: 67, where the N-terminus of such a C-terminal B3 fragment begins anywhere between amino acids 402-421, or 422-441, or 442-461, or 462-481, or 482-501, or 502-511, or 512-521, or 522-531, or 532-541, or 542-551, or 552-561 of SEQ ID NO: 67, or a polypeptide of at least 70%, or 80% or 85% or 90%, or 95% or 97% or 98% or 99% identity to SEQ ID NO: 67.

In some embodiments, the split-recombinase is a BxB1 (also known as "Bxb1") recombinase. In some embodiments, a split-recombinase protein comprises at least two, or at least three, or at least 4 recombinase polypeptide fragments from the Bxb1 protein of SEQ ID NO: 69, where when the fragments can complement and reconstitute to generate an active Bxb1 recombinase protein. In the avoidance of any doubt, SEQ ID NO: 69 is as follows:

```
(SEQ ID NO: 69)
MRALVVIRLSRVTDATTSPERQLESCQQLCAQRGWDVVGVAEDLDVSGAVD

PFDRKRRPNLARWLAFEEQPFDVIVAYRVDRLTRSIRHLQQLVHWAEDHKK

LVVSATEAHFDTTTPFAAVVIALMGTVAQMELEAIKERNRSAAHFNIRAGK

YRGSLPPWGYLPTRVDGEWRLVPDPVQRERILEVYHRVVDNHEPLHLVAHD

LNRRGVLSPKDYFAQLQGREPQGREWSATALKRSMISEAMLGYATLNGKTV

RDDDGAPLVRAEPILTREQLEALRAELVKTSRAKPAVSTPSLLLRVLFCAV

CGEPAYKFAGGGRKHPRYRCRSMGFPKHCGNGTVAMAEWDAFCEEQVLDLL

GDAERLEKVWVAGSDSAVELAEVNAELVDLTSLIGSPAYRAGSPQREALDA

RIAALAARQEELEGLEARPSGWEWRETGQRFGDWWREQDTAAKNTWLRSMN

VRLTFDVRGGLTRTIDFGDLQEYEQHLRLGSVVERLHTGMS.
```

In some embodiments, a split-recombinase protein comprises at least two, or at least three, or at least 4 recombinase polypeptide fragments from an amino acid sequence that is at least 75%, or at least 80%, or at least 85%, or at least 90% or at least 95%, or at least about 97%, or at least about 98%, or at least about 99% identical to SEQ ID NO: 69, where when the recombinase polypeptide fragments can complement and reconstitute to generate an active Bxb1 integrase protein.

The Bxb1 integrase, for example, catalyzes only the attB×attP reaction in the absence of an additional factor that is not found in eukaryotic cells. However, once recombination of attB×attP has occurred, the recombinase cannot mediate recombination between the resulting attL and attR hybrid recombination sites (the recombination sites that are formed upon recombination between attB and attP). As such, because Bxb1 integrase cannot alone catalyze the reverse reaction, the Bxb1 attB×attP recombination is stable (i.e., irreversible).

In some embodiments, a recombinase which can be split into two or more recombinase polypeptide fragments according to the technology as disclosed herein is Bxb1 recombinase and the corresponding recombinase recognition sequences comprise Bxb1 attB and phiC31 attP. Accordingly, in some embodiments, an active reconstituted Bxb1 protein from the protein complementation of 2 or more recombinase polypeptide fragments can recognize attB or attP sites, and results in site-specific recombination of a nucleic acid sequence between two such attB and attP sites.

Accordingly, in some embodiments, a recombinase which can be split into two or more recombinase polypeptide fragments according to the technology as disclosed herein is Bxb1, and when the two recombinase polypeptide fragments come together, they generate the active Bxb1 recombinase protein which can recognize RRS comprising attB and attP. Exemplary Bxb1 attB sequence can comprise nucleic acids TCGGCCGGCTTGTCGACGACGGCGGTCTCCGTCGT CAGGATCATCCGGGC (SEQ ID NO: 70), or a sequence with at least 85% identity to SEQ ID NO: 70 and an exemplary bxb1 attP sequence can comprise nucleic acids GTCGTGGTTTGTCTGGTCAAC-CACCGCGGTCTCAGTGGTGTACGGTA-CAAACCCCGAC (SEQ ID NO: 71), or a sequence of at least 85% identity to SEQ ID NO: 71.

In some embodiments, Bxb1 can be split into at least two, or at least 3 or more split-recombinase polypeptide fragments. As an exemplary embodiment, Bxb1 recombinase protein is split into an N-terminal fragment and a C-terminal fragment, where the N-terminal and C-terminal fragments are conjugated or attached, either directly (e.g., peptide bonds, covalent bonds or cross-linkers), or indirectly (e.g., with peptide linkers and the like) to another domain as described herein, e.g., one portion of an inducible dimerization domain, one portion of a repressible dimerization domain, a sequestering domain, or at least a portion of a nuclease. In presence of an inducer agent or inducer signal for such a domain, the N- and C-terminal Bxb1 recombinase polypeptide fragments are brought into close proximity with each other allowing protein complementation to occur and the generation of the active Bxb1 recombinase protein, which can bind to attB and attP sequences of SEQ ID NO: 70 and SEQ ID NO: 71.

Bxb1 recombinase can be split at location S where the N-terminal Bxb1 polypeptide fragment is from amino acid 1 to amino acid S (inclusive) and the C-terminal Bxb1 polypeptide fragment of the protein is from S+1 to the end of the protein (amino acid 500 of SEQ ID NO: 69). In some embodiments, a N-terminal Bxb1 recombinase polypeptide fragment comprises a continuous stretch of amino acids of a fragment of the N-terminal of SEQ ID NO: 69, where the C-terminus of such a N-terminal Bxb1 fragment ends at amino acid 468 of SEQ ID NO: 69, or the equivalent amino acid of a protein of at least 70% sequence homology to SEQ ID NO: 69. In some embodiments, a N-terminal fragment of SEQ ID NO: 69 comprises a N-terminal signal sequence, which is as follows: MDPKKKRKV (SEQ ID NO: 72).

In some embodiments, a C-terminal Bxb1 recombinase polypeptide fragment comprises a continuous stretch of amino acids of a fragment of the C-terminal of SEQ ID NO: 69, where the N-terminus of such a C-terminal Bxb1 fragment begins at amino acid of 469 of SEQ ID NO: 69, or the equivalent amino acid of a protein of at least 70% sequence homology to SEQ ID NO: 69. In some embodiments, exemplary N-terminal Bxb1 recombinase polypeptide fragments and exemplary C-terminal Bxb1 recombinase polypeptides are disclosed in Table 10.

TABLE 10

Exemplary Bxb1 recombinase polypeptide fragments in a two-split Bxb1 system

| Split-Bxb1 recombinase | N-terminal fragment (aa of SEQ ID NO: 69) | C-terminal fragment (aa of SEQ ID NO: 69) |
| --- | --- | --- |
| Bxb1-1 | 1-468 (Bxb1-1-N) | 469-500 (Bxb1-1-C) |
| Bxb1-2 | 1 and aa 20-100 (Bxb1-2-N) | 21-101 and 500 (Bxb1-2-C) |
| Bxb1-3 | 1 and aa 100-200 (Bxb1-3-N) | 101-201 and 500 (Bxb1-3-C) |
| Bxb1-4 | 1 and aa 200-300 (Bxb1-4-N) | 201-301 and 500 (Bxb1-4-C) |
| Bxb1-5 | 1 and aa 300-400 (Bxb1-5-N) | 301-401 and 500 (Bxb1-4-C) |
| Bxb1-6 | 1 and aa 400-497 (Bxb1-5-N) | 401- and 498 (Bxb1-5-C) |

As discussed above, Bxb1 recombinase can be split into three or more fragments.

In some embodiments, a N-terminal Bxb1 recombinase polypeptide fragment comprises a continuous stretch of amino acids of a fragment of the N-terminal of SEQ ID NO: 69, where the C-terminus of such a N-terminal Bxb1 fragment ends anywhere between amino acids 20-30, or 31-40, or 41-50, or 51-60, or 61-70, or 71-80, or 81-90, or 91-100 of SEQ ID NO: 69, or a polypeptide of at least 70%, or 80% or 85% or 90%, or 95% or 97% or 98% or 99% identity to SEQ ID NO: 69. In such embodiments, a cognate C-terminal Bxb1 recombinase polypeptide fragment comprises a continuous stretch of amino acids of a fragment of the C-terminal of SEQ ID NO: 69, where the N-terminus of such a C-terminal Bxb1 fragment begins anywhere between amino acids 21-31, or 32-41, or 42-51, or 52-61, or 62-72, or 72-81, or 82-91, or 91-101 of SEQ ID NO: 69, or a polypeptide of at least 70%, or 80% or 85% or 90%, or 95% or 97% or 98% or 99% identity to SEQ ID NO: 69.

In some embodiments, a N-terminal Bxb1 recombinase polypeptide fragment comprises a continuous stretch of amino acids of a fragment of the N-terminal of SEQ ID NO: 69, where the C-terminus of such a N-terminal Bxb1 fragment ends anywhere between amino acids 101-150, or 151-200, or 201-250, or 251-300, or 301-350, or 351-400 of SEQ ID NO: 69, or a polypeptide of at least 700, or 80% or 85% or 90%, or 95% or 97% or 98% or 99% identity to SEQ ID NO: 69. In such embodiments, a C-terminal Bxb1 recombinase polypeptide fragment comprises a continuous stretch of amino acids of a fragment of the C-terminal of SEQ ID NO: 69, where the N-terminus of such a C-terminal Bxb1 fragment begins anywhere between amino acids 102-151, or 152-201, or 202-251, or 252-301, or 302-351, or 352-401 of SEQ ID NO: 69, or a polypeptide of at least 70%, or 80% or 85% or 90%, or 95% or 97% or 98% or 99% identity to SEQ ID NO: 69.

In some embodiments, a N-terminal Bxb1 recombinase polypeptide fragment comprises a continuous stretch of amino acids of a fragment of the N-terminal of SEQ ID NO: 69, where the C-terminus of such a N-terminal Bxb1 fragment ends anywhere between amino acids 401-420-, or 421-440, or 441-460, or 461-480, or 481-497, of SEQ ID NO: 69, or a polypeptide of at least 70%, or 80% or 85% or 90%, or 95% or 97% or 98% or 99% identity to SEQ ID NO: 69. In such embodiments, a cognate C-terminal Bxb1 recombinase polypeptide fragment comprises a continuous stretch of amino acids of a fragment of the C-terminal of SEQ ID NO: 69, where the N-terminus of such a C-terminal Bxb1 fragment begins anywhere between amino acids 402-421, or 422-441, or 442-461, or 462-481, or 482-498 of SEQ ID NO: 69, or a polypeptide of at least 70%, or 80% or 85% or 90%, or 95% or 97% or 98% or 99% identity to SEQ ID NO: 69.

In several aspects, described herein are polypeptides comprising at least two inducible dimerization domains, also referred to herein as induced proximity domains or heterodimerization domains or IDD. As used herein the term "inducible dimerization domains" refers to at least two domains that are induced to dimerize or come into close proximity in the presence of a stimulus (e.g., chemical inducer, light, etc.). In some embodiments of any of the aspects, the inducible dimerization domain pair comprises a first inducible dimerization domain ($D^1$) (also referred to as a "first member of an inducible dimerization domain") and at least a second inducible dimerization domain ($D^2$) (also referred to as a "second member of an inducible dimerization domain"), wherein in the presence of an inducer agent or inducer signal, $D^1$ and $D^2$ come together. In some embodiments of any of the aspects, a first polypeptide is linked to $D^1$ (or $D^2$), and a second polypeptide is linked to $D^1$ (or $D^2$). Thus, in the presence of an inducer agent or inducer signal, $D^1$ and D2 come together linked to resulting in the linkage of the first and second polypeptides and complementarian of the polypeptide fragments of the nuclease or recombinase. In the absence of an inducer agent or inducer signal, the first and second polypeptides are uncoupled or unlinked, and there is no complementarian of the polypeptide fragments of the nuclease or recombinase.

In some embodiments of any of the aspects, a polypeptide or system as described herein comprises 1, 2, 3, 4, 5, or more inducible dimerization domain(s). In some embodiments of any of the aspects, each polypeptide each comprises one member of an inducible dimerization domain. In a system comprising two polypeptides, the system comprises one pair of inducible dimerization domains, one member of the pair for each polypeptide. In a system comprising three polypeptides, the system comprises two pairs of inducible dimerization domains, one member of each pair for each polypeptide. In embodiments comprising multiple inducible dimerization domains, the multiple inducible dimerization domains can be different individual inducible dimerization domains or multiple copies of the same inducible dimerization domain, or a combination of the foregoing.

In some embodiments of any of the aspects, $D^1$ is N terminal to the second domain in the polypeptide (e.g., $N^1$, $R^1$). In some embodiments of any of the aspects, $D^1$ is C terminal to the second domain in the polypeptide (e.g., $N^1$, $R^1$). In some embodiments of any of the aspects, $D^2$ is N terminal to the second domain in the polypeptide (e.g., $N^2$, $R^2$). In some embodiments of any of the aspects, $D^2$ is C terminal to the second domain in the polypeptide (e.g., $N^2$, $R^2$).

In one aspect described herein is an inducible dimerization system comprising: (a) a first polypeptide comprising from N-terminal to C-terminal: (i) a first polypeptide fragment (e.g., $N^1$, $R^1$); and (ii) a first member of an inducible dimerization domain ($D^1$); and (b) a second polypeptide comprising from N-terminal to C-terminal: (i) a second member of the inducible dimerization domain ($D^2$); and (ii) a second polypeptide fragment (e.g., $N^2$, $R^2$).

In one aspect described herein is an inducible dimerization system comprising: (a) a first polypeptide comprising from N-terminal to C-terminal: (i) a first member of an inducible dimerization domain ($D^1$); and (ii) a first polypeptide fragment (e.g., $N^1$, $R^1$); and (b) a second polypeptide comprising from N-terminal to C-terminal: (i) a second polypeptide fragment (e.g., $N^2$, $R^2$); and (ii) a second member of the inducible dimerization domain ($D^2$).

In some embodiments of any of the aspects, the first ($D^1$) and second ($D^2$) members of the inducible dimerization domain are selected from any one or more of: (1) $D^1$ and $D^2$ each comprise a VHH camelid antibody (CaffVHH or tandem CaffVHH), wherein the CaffVHH domains bind to the inducer agent caffeine; (2) $D^1$ (or $D^2$) comprising a GID1 domain or a fragment thereof, and $D^2$ (or $D^1$) comprising a GAI domain, wherein the GID1 domain and GAI domain bind to the inducer agent Gibberellin Ester (GIB); (3) $D^1$ (or $D^2$) comprising a FKBP domain or a fragment thereof, and $D^2$ (or $D^1$) comprising a FRB domain, wherein the FKBP domain and FRB domain bind to the inducer agent Rapalog (RAP); (4) $D^1$ (or $D^2$) comprising a PYL domain or a fragment thereof, and $D^2$ (or $D^1$) comprising a ABI domain, wherein the PYL domain and ABI domain bind to the inducer agent Abscisic acid (ABA); (5) $D^1$ (or $D^2$) comprising a Light-inducible dimerization domain (LIDD), wherein a LIDD dimerizes with a complementary LIDD ($D^2$ (or $D^1$)) upon exposure to a light inducer signal of an appropriate wavelength; or (6) $D^1$ (or $D^2$) comprises a repressible protease and $D^2$ (or $D^1$) comprises a reader domain, wherein the reader domain specifically binds to a repressible protease in the presence of an inducer agent comprising a specific protease inhibitor.

In some embodiments of any of the aspects, the polypeptide or system is in combination with 1, 2, 3, 4, 5, or more inducer agents, i.e., that induce dimerization or proximity of the inducible dimerization domains. In some embodiments of any of the aspects, the polypeptides are in combination with one inducer agent. In embodiments comprising multiple inducer agents, the multiple inducer agents can be different individual inducer agents or multiple copies of the same inducer agent, or a combination of the foregoing.

In some embodiments, the first ($D^1$) and second ($D^2$) members of the inducible dimerization domain comprise a caffeine-induced dimerization system, such as a VHH camelid antibody (referred to as aCaffVHH; see e.g., SEQ ID NOs: 1977, 1980) that has high affinity (Kd=500 nM) and homodimerizes in the presence of caffeine.

In some embodiments of any of the aspects, at least one of the CaffVHH $D^1$ or CafVHH $D^2$ is encoded by a nucleic acid that is codon-optimized (see e.g., SEQ ID NOs: 1978-1979). Such codon optimization prevents recombination of the nucleic acids encoding the CafVHH domains.

In some embodiments of any of the aspects, $D^1$ and $D^2$ each comprise a VHH camelid antibody that specifically binds to caffeine (CaffVHH). Without wishing to be bound by theory, the binding mechanism involves the first CaffVHH binding to caffeine, which offers another interaction area to a second CafVHH; specifically, the hydrophobic regions exposed on the first CaffVHH after binding to caffeine allows binding of the second CaffVHH, resulting in a high affinity of the dimerization complex (Kb=$7.1 \times 10^7$).

See e.g., Lesne et al. Sci Rep 9, 1840 (2019); the content of which is incorporated herein by reference in its entirety.

In some embodiments of any of the aspects, $D^1$ and $D^2$ each comprise a tandem VHH camelid antibody that specifically binds to caffeine (tandem CaffVHH; see e.g., SEQ ID NOs: 1971, 1981). A tandem CaffVHH comprises two copies of CaffVHH linked together, such that a pair of tandem CaffVHH domains binds to two molecules of caffeine (see e.g., FIG. 2B). In some embodiments of any of the aspects, the nucleic acid encoding the tandem CaffVHH comprises a CaffVHH domain (see e.g., SEQ ID NO: 1977) and a codon-optimized CaffVHH domain (see e.g., SEQ ID NO: 1978), which can be 3' or 5' of the CaffVHH domain.

In some embodiments of any of the aspects, $D^1$ and $D^2$ each comprise CaffVHH (see e.g., SEQ ID NO: 1980) that together bind to a single molecule of caffeine. In some embodiments of any of the aspects, $D^1$ and $D^2$ each comprise tandem CaffVHH (see e.g., SEQ ID NO: 1981) that together bind to two molecules of caffeine. See e.g., the schematic in FIG. 2B.

In some embodiments of any of the aspects, the single or tandem CaffVHH domain comprises SEQ ID NO: 1980 (single CaffVHH) or SEQ ID NO: 1981 (tandem CaffVHH) or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 1980-1981, that maintains the same function.

In some embodiments of any of the aspects, the single or tandem CaffVHH domain is encoded by a nucleic acid comprising SEQ ID NO: 1977 (single CaffVHH), SEQ ID NO: 1978 (codon-optimized single CaffVHH) or SEQ ID NO: 1979 (tandem CaffVHH) or a nucleic acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 1977-1979, that maintains the same function.

CaffVHH, 357 nucleotides (nt)

SEQ ID NO: 1977

```
GAAGTTCAACTGCAAGCTTCTGGCGGCGGCCTGGTTCAAGCTGGCGGCTCT
CTGCGTCTGTCTTGCACTGCTTCTGGCCGTACTGGCACTATCTACTCTATG
GCTTGGTTCCGTCAAGCTCCTGGCAAAGAACGTGAATTCCTGGCTACTGTT
GGCTGGTCTTCTGGCATCACTTACTACATGGATTCTGTTAAAGGCCGTTTC
ACTATCTCTCGTGATAACGCTAAAAACTCTGCTTACCTGCAAATGAACTCT
CTGAAACCTGAAGATACTGCTGTTTACTACTGCACTGCTACTCGTGCTTAC
TCTGTTGGCTACGATTACTGGGGCCAAGGCACTCAAGTTACTGTTTCTCA
T,
```

CaffVHH codon-optimized, 357 nt

SEQ ID NO: 1978

```
GAAGTGCAACTCCAAGCTAGCGGAGGTGGTCTGGTACAAGCTGGCGGCAGT
TTGAGGCTTTCTTGTACAGCTAGTGGGCGGACGGGCACAATTTATTCTATG
GCTTGGTTCCGACAGGCTCCTGGAAAAGAGAGAGAATTTCTTGCGACCGTC
GGTTGGTCCAGCGGAATAACTTATTATATGGACAGCGTTAAGGGAAGGTTT
ACGATAAGTAGAGACAATGCAAAGAACTCCGCCTACTTGCAAATGAACAGT
```

-continued
TTGAAACCTGAGGATACAGCAGTCTACTATTGTACCGCTACTCGCGCTTAC

AGCGTGGGATACGATTACTGGGGTCAGGGGACTCAGGTCACCGTTAGCCA

T, tandem CaffVHH, 723 nt; bolded text indicates the
first CaffVHH domain (e.g., codon-optimized; see
e.g., SEQ ID NO: 1978); italicized text indicates
the second CaffVHH domain (see e.g., SEQ ID NO:
1977):
SEQ ID NO: 1979
ATGGAAGTGCAACTCCAAGCTAGCGGAGGTGGTCTGGTACAAGCTGGCGGC

AGTTTGAGGCTTTCTTGTACAGCTAGTGGGCGGACGGGCACAATTTATTCT

ATGGCTTGGTTCCGACAGGCTCCTGGAAAAGAGAGAGAATTTCTTGCGACC

GTCGGTTGGTCCAGCGGAATAACTTATTATATGGACAGCGTTAAGGGAAGG

TTTACGATAAGTAGAGACAATGCAAAGAACTCCGCCTACTTGCAAATGAAC

AGTTTGAAACCTGAGGATACAGCAGTCTACTATTGTACCGCTACTCGCGCT

TACAGCGTGGGATACGATTACTGGGGTCAGGGGACTCAGGTCACCGTTAGC

CATGTCGAGGAAGTTCAACTGCAAGCTTCTGGCGGCGGCCTGGTTCAAGCT

GGCGGCTCTCTGCGTCTGTCTTGCACTGCTTCTGGCCGTACTGGCACTATC

TACTCTATGGCTTGGTTCCGTCAAGCTCCTGGCAAAGAACGTGAATTCCTG

GCTACTGTTGGCTGGTCTTCTGGCATCACTTACTACATGGATTCTGTTAAA

GGCCGTTTCACTATCTCTCGTGATAACGCTAAAAACTCTGCTTACCTGCAA

ATGAACTCTCTGAAACCTGAAGATACTGCTGTTTACTACTGCACTGCTACT

CGTGCTTACTCTGTTGGCTACGATTACTGGGGCCAAGGCACTCAAGTTACT

GTTTCTCAT,

CaffVHH, 119 aa
SEQ ID NO: 1980
EVQLQASGGGLVQAGGSLRLSCTASGRTGTIYSMAWFRQAPGKEREFLATV

GWSSGITYYMDSVKGRFTISRDNAKNSAYLQMNSLKPEDTAVYYCTATRAY

SVGYDYWGQGTQVTVSH, tandem CaffVHH, 241 aa; bolded text indicates the
first CaffVHH domain (see e.g., SEQ ID NO: 1980);
italicized text indicates the second CaffVHH domain
(see e.g., SEQ ID NO: 1980):
SEQ ID NO: 1981
MEVQLQASGGGLVQAGGSLRLSCTASGRTGTIYSMAWFRQAPGKEREFLAT

VGWSSGITYYMDSVKGRFTISRDNAKNSAYLQMNSLKPEDTAVYYCTATRA

YSVGYDYWGQGTQVTVSHEEVQLQASGGGLVQAGGSLRLSCTASGRTGTI

YSMAWFRQAPGKEREFLATVGWSSGITYYMDSVKGRFTISRDNAKNSAYLQ

MNSLKPEDTAVYYCTATRAYSVGYDYWGQGTQVTVSH,

In some embodiments of any of the aspects, a polypeptide as described herein comprises a linker domain adjacent (e.g., N-terminal and/or C-terminal) to the CaffVHH domain. In some embodiments of any of the aspects, the reader domain linker comprises SEQ ID NO: 1982 (SSGGSGSGSSGGS) or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 1982.

In some embodiments of any of the aspects, the dimerization inducer agent (e.g., for CaffVHH domains) is caffeine (shown below) or a caffeine metabolite (e.g., theophylline, theobromine, and paraxanthine) or an analog thereof. See e.g., Sonneson et al., Biochemistry 2009, 48, 29, 6693-6695, the content of which is incorporated herein by reference in its entirety.

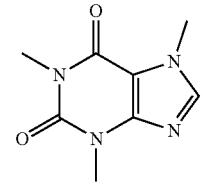

In some embodiments, the IDD pair is selected from a combinatorial binders-enabled selection of chemically induced dimerization systems (COMBINES-CID), using a specific chemical ligand. As a non-limiting example, the ligand can be CBD (cannabidiol). In some embodiments, the inducible dimerization domain pair comprises human antibody-based chemically induced dimerizes (AbCIDs), which are derived from known small-molecule-protein complexes by selecting for synthetic antibodies that recognize the chemical epitope created by the small molecule bound to the protein (e., g ABT-737). In some embodiments, the IDD pair comprises Calcineurin and FKBP, which come together in the presence of FK506. In some embodiments, the IDD pair comprises Calcineurin and prolyl isomerase CyP, which come together in the presence of Cyclosporine A. In some embodiments, the IDD pair comprises CyP and FKBP, which come together in the presence of FKCsA, a fusion of FK506 and Cyclosprin A. In some embodiments, the IDD pair comprises two copies of FKBP, which come together in the presence of FK2012, a fusion of two FK506 molecules. See e.g., Franco et al., Journal of Chromatography B, Volume 878, Issue 2, 15 Jan. 2010, Pages 177-186; Liang et al. Sci Signal 2011 Mar. 15; 4(164):rs2; Laura A. Banaszynski et al. JACS 2005 Apr. 6; 127(13):4715-21; Miyamoto et al. Nat Chem Biol Nature Chemical Biology volume 8, pages 465-470(2012); Bojar et al. Nature Communications volume 9, Article number: 2318 (2018); Kang et al. JACS 2019 Jul. 17; 141(28): 10948-10952; Hill et al. Nat ChemBio 2018 February; 14(2):112-117; Stanton et al. Science 2018 Mar. 9; 359(6380): eaao5902; Weinberg et al. Nat Biotech 2017 May; 35(5): 453-462; Matthew J Kennedy, Nature Methods volume 7, pages 973-975(2010); US Patent Applications US20180163195 and US20170183654; U.S. Pat. No. 8,735,096; the contents of each of which are incorporated herein by reference in their entireties.

In some embodiments of any of the aspects, the IDD pair comprises an ABI (ABA insensitive) domain and a PYL (pyrabactin resistance-like) domain, derived from components of the Abscisic acid (ABA) signaling pathway from *Arabidopsis thaliana*. In some embodiments of any of the aspects, $D^1$ comprises a PYL domain or a fragment thereof, and $D^2$ comprises an ABI domain, wherein the PYL domain and ABI domain bind to the inducer agent Abscisic acid (ABA). In some embodiments of any of the aspects, $D^2$ comprises a PYL domain or a fragment thereof, and $D^1$ comprises an ABI domain, wherein the PYL domain and ABI domain bind to the inducer agent Abscisic acid (ABA).

In some embodiments of any of the aspects, the IDD pair comprises the interacting complementary surfaces (CSs) of PYL1 (PYLcs, amino acids 33 to 209) and ABI1 (ABIcs, amino acids 126 to 423). In some embodiments of any of the aspects, the ABI domain (e.g., SEQ ID NO: 73 or 75) comprises mutations A18D and E108G. In some embodiments of any of the aspects, the ABI domain further comprises a detectable marker (e.g., a FLAG tag). In some embodiments of any of the aspects, the PYL domain further comprises a detectable marker (e.g., an HA tag).

In some embodiments of any of the aspects, the ABI domain comprises SEQ ID NOs: 73 or 75 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 73 or 75, that maintains the same function.

In some embodiments of any of the aspects, the PYL domain comprises SEQ ID NOs: 74 or 76 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 74 or 76, that maintains the same function.

```
ABI binding motif (297 aa)
                                    SEQ ID NO: 73
PLYGFTSICGRRPEMEDAVSTIPRFLQSSSGSMLDGRFDPQSAAHFFGVYD

GHGGSQVANYCRERMHLALAEEIAKEKPMLCDGDTWLEKWKKALFSFLRVD

SEIGSVAPETVGSTSVVAVVFPSHIFVANCGDSRAVLCRGKTALPLSVDHK

PDREDEAARIEAAGGKVIQWNGARVFGVLAMSRSIGDRYLKPSIIPDPEVT

AVKRVKEDDCLILASDGVWDVMTDEEACEMARKRILLWHKKNAVAGDASLL

ADERRKEGKDPAAMSAAEYLSKLAIQRGSKDNISVVVVDLK,

PYL binding motif (188 aa)
                                    SEQ ID NO: 74
APTQDEFTQLSQSIAEFHTYQLGNGRCSSLLAQRIHAPPETVWSVVRRFDR

PQIYKHFIKSCNVSEDFEMRVGCTRDVNVISGLPANTSRERLDLLDDDRRV

TGFSITGGEHRLRNYKSVTTVHRFEKEEEEERIWTVVLESYVVDVPEGNSE

EDTRLFADTVIRLNLQKLASITEAMNYPYDVPDYA,

ABI cs C01 (298 aa)
                                    SEQ ID NO: 75
VPLYGFTSICGRRPEMEAAVSTIPRFLQSSSGSMLDGRFDPQSAAHFFGVY

DGHGGSQVANYCRERMHLALAEEIAKEKPMLCDGDTWLEKWKKALFNSFLR

VDSEIESVAPETVGSTSVVAVVFPSHIFVANCGDSRAVLCRGKTALPLSVD

HKPDREDEAARIEAAGGKVIQWNGARVFGVLAMSRSIGDRYLKPSIIPDPE

VTAVKRVKEDDCLILASDGVWDVMTDEEACEMARKRILLWHKKNAVAGDAS

LLADERRKEGKDPAAMSAAEYLSKLAIQRGSKDNISVVVVDLK,

PYL1cs Domain (177 aa)
                                    SEQ ID NO: 76
TQDEFTQLSQSIAEFHTYQLGNGRCSSLLAQRIHAPPETVWSVVRRFDRPQ

IYKHFIKSCNVSEDFEMRVGCTRDVNVISGLPANTSRERLDLLDDDRRVTG

FSITGGEHRLRNYKSVTTVHRFEKEEEEERIWTVVLESYVVDVPEGNSEED

TRLFADTVIRLNLQKLASITEAMN,
```

In some embodiments of any of the aspects, the proximity inducer agent (e.g., for ABI and PYL domains) is abscisic acid (ABA):

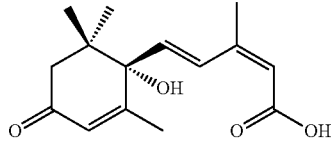

In some embodiments of any of the aspects, the IDD pair are FKBP (FK506- and rapamycin-binding protein) and FKBP12-rapamycin-binding protein (FRB) proteins, which come together and dimerize in the presence of a rapalog. In some embodiments of any of the aspects, $D^1$ comprises a FKBP domain or a fragment thereof, and $D^2$ comprises a FRB domain, wherein the FKBP domain and FRB domain bind to the inducer agent Rapalog (RAP). In some embodiments of any of the aspects, $D^2$ comprises a FKBP domain or a fragment thereof, and $D^1$ comprises a FRB domain, wherein the FKBP domain and FRB domain bind to the inducer agent Rapalog (RAP).

In some embodiments of any of the aspects, the FKBP domain comprises SEQ ID NO: 77 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 77, that maintains the same function. In some embodiments of any of the aspects, the FRB domain comprises SEQ ID NO: 78 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 78, that maintains the same function.

```
SEQ ID NO: 77, FKBP aa binding motif:
SRGVQVETISPGDGRTFPKRGQTCVVHYTGMLEDGKKFDSSRDRNKPFKFM

LGKQEVIRGWEEGVAQMSVGQRAKLTISPDYAYGATGHPGIIPPHATLVFD

VELLKLE

SEQ ID NO: 78, FRB binding motif,
ILWHEMWHEGLEEASRLYFGERNVKGMFEVLEPLHAMMERGPQTLKETSFN

QAYGRDLMEAQEWCRKYMKSGNVKDLLQAWDLYYHVFRRIS
```

In some embodiments of any of the aspects, the proximity inducer agent (e.g., for FKBP and FRB domains) is rapamycin shown below. In some embodiments of any of the aspects, the proximity inducer agent (e.g., for FKBP and FRB domains) is a rapalog, i.e., a rapamycin analog. In some embodiments of any of the aspects, the rapalog is Sheild-1, shown below.

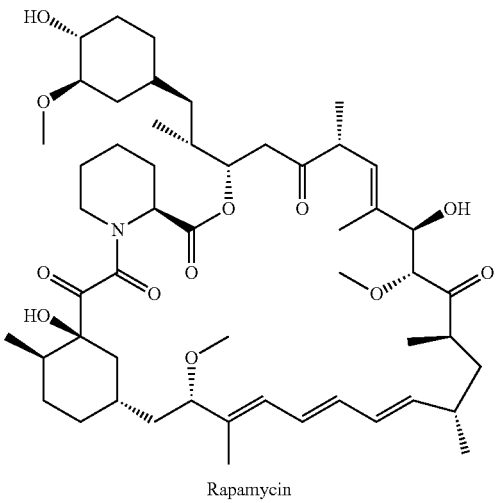

Rapamycin

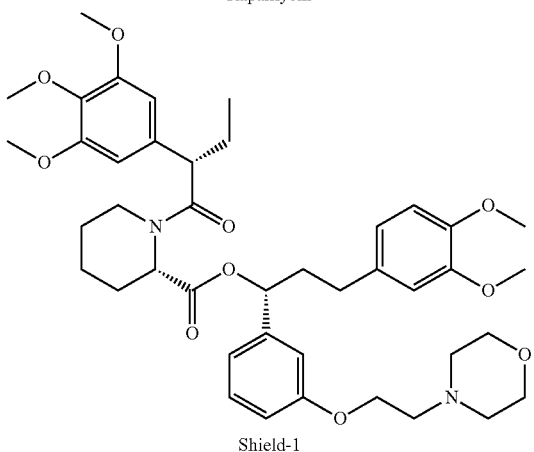

Shield-1

In some embodiments of any of the aspects, the IDD pair are GAI (Gibberellin insensitive) and GID1 (Gibberellin insensitive dwarf1) proteins, derived from, *Arabidopsis thaliana*, which come together in the presence of Gibberellin Ester (GE). In some embodiments of any of the aspects, $D^1$ comprises a GID1 domain or a fragment thereof, and $D^2$ comprises a GAI domain, wherein the GID1 domain and GAI domain bind to the inducer agent Gibberellin Ester (GIB). In some embodiments of any of the aspects, $D^2$ comprises a GID1 domain or a fragment thereof, and $D^1$ comprises a GAI domain, wherein the GID1 domain and GAI domain bind to the inducer agent Gibberellin Ester (GIB).

In some embodiments of any of the aspects, the GAI domain comprises SEQ ID NO: 79 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 79, that maintains the same function. In some embodiments of any of the aspects, the GAI domain comprises the amino-terminal DELLA domain of GAI. In some embodiments of any of the aspects, the GID domain comprises SEQ ID NO: 80 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 80, that maintains the same function.

```
GAI binding motif,
                                  SEQ ID NO: 79
MKRDHHHHHHQDKKTMMMNEEDDGNGMDELLAVLGYKVRSSEMADVAQKLE

QLEVMMSNVQEDDLSQLATETVHYNPAELYTWLDSMLTDLN,

GID1 binding motif
                                  SEQ ID NO: 80
MAASDEVNLIESRTVVPLNTWVLISNFKVAYNILRRPDGTFNRHLAEYLDR

KVTANANPVDGVFSFDVLIDRRINLLSRVYRPAYADQEQPPSILDLEKPVD

GDIVPVILFFHGGSFAHSSANSAIYDTLCRRLVGLCKCVVVSVNYRRAPEN

PYPCAYDDGWIALNWVNSRSWLKSKKDSKVHIFLAGDSSGGNIAHNVALRA

GESGIDVLGNILLNPMFGGNERTESEKSLDGKYFVTVRDRDWYWKAFLPEG

EDREHPACNPFSPRGKSLEGVSFPKSLVVVAGLDLIRDWQLAYAEGLKKAG

QEVKLMHLEKATVGFYLLPNNNHFHNVMDEISAFVNAEC,
```

In some embodiments of any of the aspects, the proximity inducer agent (e.g., for GAI and GID1 domains) is a bioactive gibberellin (shown below), a Gibberellin Ester (GE), or another gibberellin analog.

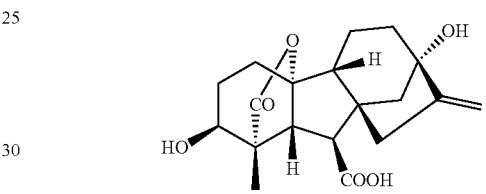

In some embodiments of any of the aspects, the IDD pair comprises a light-inducible dimerization domain (LIDD) pair, non-limiting examples of which include nMag/nMag, CRY2/CIBN, and photochromic proteins. In some embodiments of any of the aspects, $D^1$ comprises a Light-inducible dimerization domain (LIDD), wherein a LIDD dimerizes with a complementary LIDD ($D^2$) upon exposure to a light inducer signal of an appropriate wavelength. In some embodiments of any of the aspects, $D^2$ comprises a Light-inducible dimerization domain (LIDD), wherein a LIDD dimerizes with a complementary LIDD ($D^1$) upon exposure to a light inducer signal of an appropriate wavelength.

In some embodiments of any of the aspects, the LIDD is nMag or CIBN or a photochromic protein domain. In some embodiments of any of the aspects, nMag can dimerize with the complementary LIDD pMag upon exposure to a blue light inducer signal. In some embodiments of any of the aspects, CIBN can dimerize with the complementary CRY2 upon exposure to a blue inducer light signal. In some embodiments of any of the aspects, the photochromic proteins can dimerize upon exposure to a blue inducer light signal. In some embodiments of any of the aspects, the light inducer signal is a pulse light signal.

In some embodiments, the IDD pair comprises a light-inducible dimerization domain (LIDD) pair, such as nMag and pMag proteins, which come together and dimerize in a blue light signal, e.g., after a blue light pulse signal, or pulse of a light of an appropriate wavelength. In some embodiments of any of the aspects, the nMag domain comprises SEQ ID NO: 81 or an amino acid sequence that is at least 70%, at least 75%, at least 80%, at least 85%, at least 90%, at least 91%, at least 92%, at least 93%, at least 94%, at least 95%, at least 96%, at least 97%, at least 98%, or at least 99% identical to the sequence of SEQ ID NO: 81, that maintains the same function. In some embodiments of any of the aspects, the pMag domain comprises SEQ ID NO: 82 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 82, that maintains the same function.

nMag binding motif
SEQ ID NO: 81
HTLYAPGGYDIMGYLDQIGNRPNPQVELGPVDTSCALILCDLKQKDTP

IVYASEAFLYMTGYSNAEVLGRNCRFLQSPDGMVKPKSTRKYVDSNTI

NTMRKAIDRNAEVQVEVVNFKKNGQRFVNFLTMIPVRDETGEYRYSMG

FQCETE, pMag binding motif
SEQ ID NO: 82
HTLYAPGGYDIMGYLRQIRNRPNPQVELGPVDTSCALILCDLKQKDTP

IVYASEAFLYMTGYSNAEVLGRNCRFLQSPDGMVKPKSTRKYVDSNTI

NTMRKAIDRNAEVQVEVVNFKKNGQRFVNFLTMIPVRDETGEYRYSMG

FQCETE,

In some embodiments, the IDD pair comprises a light-inducible dimerization domain (LIDD) pair, such as cryptochrome 2 (CRY2) and CIBN (a truncated version of CIB1 (CRY2 interacting basic-helix-loop-helix 1)) and proteins, derived from *Arabidopsis thaliana*, which come together and dimerize in a blue light signal, e.g., after a blue light pulse signal, or pulse of a light of an appropriate wavelength. In some embodiments of any of the aspects, the CIBN domain comprises SEQ ID NO: 83 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 83, that maintains the same function. In some embodiments of any of the aspects, the CRY2 domain comprises SEQ ID NO: 84 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 84, that maintains the same function.

CIBN LIDD
SEQ ID NO: 83
MNGAIGGDLLLNFPDMSVLERQRAHLKYLNPTFDSPLAGFFADSSMIT

GGEMDSYLSTAGLNLPMMYGETTVEGDSRLSISPETTLGTGNFKKRKF

DTETKDCNEKKKKMTMNRDDLVEEGEEEKSKITEQNNGSTKSIKKMKH

KAKKEENNFSNDSSKVTKELEKTDYIH,

CRY2 LIDD
SEQ ID NO: 84
MKMDKKTIVWFRRDLRIEDNPALAAAAHEGSVFPVFIWCPEEEGQFYP

GRASRWWMKQSLAHLSQSLKALGSDLTLIKTHNTISAILDCIRVTGAT

KVVFNHLYDPVSLVRDHTVKEKLVERGISVQSYNGDLLYEPWEIYCEK

GKPFTSFNSYWKKCLDMSIESVMLPPPWRLMPITAAAEAIWACSIEEL

-continued
GLENEAEKPSNALLTRAWSPGWSNADKLLNEFIEKQLIDYAKNSKKVV

GNSTSLLSPYLHFGEISVRHVFQCARMKQIIWARDKNSEGEESADLFL

RGIGLREYSRYICFNFPFTHEQSLLSHLRFFPWDADVDKFKAWRQGRT

GYPLVDAGMRELWATGWMHNRIRVIVSSFAVKFLLLPWKWGMKYFWDT

LLDADLECDILGWQYISGSIPDGHELDRLDNPALQGAKYDPEGEYIRQ

WLPELARLPTEWIFIHPWDAPLTVLKASGVELGTNYAKPIVDIDTARE

LLAKAISRTREAQIMIGAAPDEIVADSFEALGANTIKEPGLCPSVSSN

DQQVPSAVRYNGSKRVKPEEEEERDMKKSRGFDERELFSTAESSSSSS

VFFVSQSCSLASEGKNLEGIQDSSDQITTSLGKNGCK,

In some embodiments, the IDD pair comprises a light-inducible dimerization domain (LIDD) pair, such as photochromic protein domains including, but not limited to Dronpa, Padron, rsTagRFP, and mApple, or a variant or polypeptide fragment thereof having fluorescence characteristics (e.g., Dronpa-145N, Padron-145N, or mApple-162H-164A). Such photochromic protein domains dimerize (e.g., homo-dimerize) in the presence of a specific wavelength (e.g., blue light). In some embodiments of any of the aspects, the photochromic protein domain comprises one of SEQ ID NOs: 85-88 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 85-88, that maintains the same function.

Dropna-145K (224 aa)
SEQ ID NO: 85
MSVIKPDMKIKLRMEGAVNGHPFAIEGVGLGKPFEGKQSMDLKVKEGG

PLPFAYDILTTVFCYGNRVFAKYPENIVDYFKQSFPEGYSWERSMNYE

DGGICNATNDITLDGDCYIYEIRFDGVNFPANGPVMQKRTVKWEPSTE

KLYVRDGVLKGDVNMALSLEGGGHYRCDFKTTYKAKKVVQLPDYHFVD

HHIEIKSHDKDYSNVNLHEHAEAHSELPRQAK,

Dropna-145N (224 aa)
SEQ ID NO: 86
MSVIKPDMKIKLRMEGAVNGHPFAIEGVGLGKPFEGKQSMDLKVKEGG

PLPFAYDILTTVFCYGNRVFAKYPENIVDYFKQSFPEGYSWERSMNYE

DGGICNATNDITLDGDCYIYEIRFDGVNFPANGPVMQKRTVKWEPSTE

NLYVRDGVLKGDVNMALSLEGGGHYRCDFKTTYKAKKVVQLPDYHFVD

HHIEIKSHDKDYSNVNLHEHAEAHSELPRQAK,

Padron-145N (224 aa)
SEQ ID NO: 87
MSVIKPDMKIKLRMEGAVNGHPFAIEGVGLGKPFEGKQSMDLKVKEGG

PLPFAYDILTMAFCYGNRVFAKYPENIVDYFKQSFPEGYSWERSMHYE

DGGSCNATNDITLDGDCYIYEIRFDGVNFPANGPVMQKRTVKWERSTE

NLYVRDGVLKSDGNYALSLEGGGHYRCDFKTTYKAKKVVQLPDYHSVD

HHIEIKSHDKDYSNVNLHEHAEAHSELPRQAN,

-continued mApple-162H-164A (236 aa)
SEQ ID NO: 88
MVSKGEENNMAIIKEFMRFKVHMEGSVNGHEFEIEGEGEGRPYEAFQT

AKLKVTKGGPLPFAWDILSPQFMYGSKVYIKHPADIPDYFKLSFPEGF

RWERVMNFEDGGIIHVNQDSSLQDGVFIYKVKLRGTNFPSDGPVMQKK

TMGWEASEERMYPEDGAHKAEIKKRLKLKDGGHYAAEVKTTYKAKKPV

QLPGAYIVDIKLDIVSHNEDYTIVEQYERAEGRHSTGGMDELYK,

In several aspects, described herein are polypeptides comprising a repressible protease. As used herein, the term "repressible protease" refers to a protease that can be inactivated by the presence or absence of a specific agent (e.g., that specifically binds to the protease). In some embodiments, a repressible protease is active (e.g., cleaves a protease cleavage site) in the absence of the specific agent and is inactive (e.g., does not cleave a protease cleavage site) in the presence of the specific agent. In some embodiments, the specific agent is a protease inhibitor. In some embodiments, the protease inhibitor specifically inhibits a given repressible protease as described herein.

In some embodiments of any of the aspects, a polypeptide or system as described herein comprises 1, 2, 3, 4, 5, or more repressible protease(s). In some embodiments of any of the aspects, the polypeptide or system comprises one repressible protease. In embodiments comprising multiple repressible proteases, the multiple repressible proteases can be different individual repressible proteases or multiple copies of the same repressible protease, or a combination of the foregoing.

In some embodiments of any of the aspects, $D^1$ comprises a repressible protease and $D^2$ comprises a reader domain. In some embodiments of any of the aspects, $D^2$ comprises a repressible protease and $D^1$ comprises a reader domain. In some embodiments of any of the aspects, the reader domain specifically binds to a repressible protease in the presence of a specific protease inhibitor.

Non-limiting examples of repressible proteases include hepatitis C virus proteases (e.g., NS3 and NS2-3); signal peptidase; proprotein convertases of the subtilisin/kexin family (furin, PCI, PC2, PC4, PACE4, PC5, PC); proprotein convertases cleaving at hydrophobic residues (e.g., Leu, Phe, Val, or Met); proprotein convertases cleaving at small amino acid residues such as Ala or Thr; proopiomelanocortin converting enzyme (PCE); chromaffin granule aspartic protease (CGAP); prohormone thiol protease; carboxypeptidases (e.g., carboxypeptidase E/H, carboxypeptidase D and carboxypeptidase Z); aminopeptidases (e.g., arginine aminopeptidase, lysine aminopeptidase, aminopeptidase B); prolyl endopeptidase; aminopeptidase N; insulin degrading enzyme; calpain; high molecular weight protease; and, caspases 1, 2, 3, 4, 5, 6, 7, 8, and 9. Other proteases include, but are not limited to, aminopeptidase N; puromycin sensitive aminopeptidase; angiotensin converting enzyme; pyroglutamyl peptidase II; dipeptidyl peptidase IV; N-arginine dibasic convertase; endopeptidase 24.15; endopeptidase 24.16; amyloid precursor protein secretases alpha, beta and gamma; angiotensin converting enzyme secretase; TGF alpha secretase; T F alpha secretase; FAS ligand secretase; TNF receptor-I and -II secretases; CD30 secretase; KL1 and KL2 secretases; IL6 receptor secretase; CD43, CD44 secretase; CD 16-1 and CD 16-11 secretases; L-selectin secretase; Folate receptor secretase; MMP 1, 2, 3, 7, 8, 9, 10, 11, 12, 13, 14, and 15; urokinase plasminogen activator; tissue plasminogen activator; plasmin; thrombin; BMP-1 (procollagen C-peptidase); ADAM 1, 2, 3, 4, 5, 6, 7, 8, 9, 10, and 11; and, granzymes A, B, C, D, E, F, G, and H. For a discussion of proteases, see, e.g., V. Y. H. Hook, Proteolytic and cellular mechanisms in prohormone and proprotein processing, RG Landes Company, Austin, Tex., USA (1998); N. M. Hooper et al., Biochem. J. 321: 265-279 (1997); Z. Werb, Cell 9 1: 439-442 (1997); T. G. Wolfsberg et al., J. Cell Biol. 131: 275-278 (1995); K. Murakami and J. D. Etlinger, Biochem. Biophys. Res. Comm. 146: 1249-1259 (1987); T. Berg et al., Biochem. J. 307: 313-326 (1995); M. J. Smyth and J. A. Trapani, Immunology Today 16: 202-206 (1995); R. V. Talanian et al., J. Biol. Chem. 272: 9677-9682 (1997); and N. A. Thomberry et a, J. Biol. Chem. 272: 17907-1791 1 (1997); International Patent Application WO2019118518; the contents of each of which are incorporated herein by reference in their entireties.

In some embodiments of any of the aspects, the repressible protease is hepatitis C virus (HCV) nonstructural protein 3 (NS3). NS3, also known as p-70, is a viral nonstructural protein that is a 70 kDa cleavage product of the hepatitis C virus polyprotein. The 631-residue HCV NS3 protein is a dual-function protein, containing the trypsin/chymotrypsin-like serine protease in the N-terminal region and a helicase and nucleoside triphosphatase in the C-terminal region. The minimal sequences required for a functional serine protease activity comprise the N-terminal 180 amino acids of the NS3 protein, which can also be referred to as "NS3a". Deletion of up to 14 residues from the N terminus of the NS3 protein is tolerated while maintaining the serine protease activity. Accordingly, the repressible proteases described herein comprise at the least residues 14-180 of the wildtype NS3 protein.

HCV has at least seven genotypes, labeled 1 through 7, which can also be further designated with "a" and "b" subtypes. Accordingly, the repressible protease can be an HCV genotype 1 NS3, an HCV genotype 1a NS3, an HCV genotype 1b NS3, an HCV genotype 2 NS3, an HCV genotype 2a NS3, an HCV genotype 2b NS3, an HCV genotype 3 NS3, an HCV genotype 3a NS3, an HCV genotype 3b NS3, an HCV genotype 4 NS3, an HCV genotype 4a NS3, an HCV genotype 4b NS3, an HCV genotype 5 NS3, an HCV genotype 5a NS3, an HCV genotype 5b NS3, an HCV genotype 6 NS3, an HCV genotype 6a NS3, an HCV genotype 6b NS3, an HCV genotype 7 NS3, an HCV genotype 7a NS3, or an HCV genotype 7b NS3. In some embodiments of any of the aspects, the repressible protease can be any known HCV NS3 genotype, variant, or mutant, e.g., that maintains the same function. In some embodiments of any of the aspects, the NS3 sequence comprises residues 1-180 of the NS3 protein from HCV-H, HCV-1, HCV-J1, HCV-BK, HCV-JK1, HCV-J4, HCV-J, HCV-J6, C14112, HCV-J8, D14114, HCV-Nz11, or HCV-K3a (see e.g., Chao Lin, Chapter 6: HCV NS3-4A Serine Protease, Hepatitis C Viruses: Genomes and Molecular Biology, Editor: Tan SL, Norfolk (UK): Horizon Bioscience, 2006; the content of which is incorporated herein by reference in its entirety). In some embodiments of any of the aspects, the repressible protease is a chimera of 2, 3, 4, 5, or more different NS3 genotypes, variants, or mutants as described herein, such that the protease maintains its cleavage and/or binding functions.

In some embodiments of any of the aspects, the repressible protease of a polypeptide as described herein comprises one of SEQ ID NOs: 89-104 or SEQ ID NOs: 154-162 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 89-102 or SEQ ID NOs: 154-162 that maintains the same functions.

In some embodiments of any of the aspects, the repressible protease of a polypeptide as described herein comprises one of SEQ ID NOs: 89-102 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 89-102 that maintains the same functions as one of SEQ ID NOs: 89-102.

In some embodiments of any of the aspects, a polypeptide as described herein comprises a repressible protease that is catalytically active. For HCV NS3, the catalytic triad comprises His-57, Asp-81, and Ser-139. In regard to a repressible protease, "catalytically active" refers to the ability to cleave at a protease cleavage site. In some embodiments of any of the aspects, the catalytically active repressible protease can be any repressible protease as described further herein that maintains the catalytic triad, i.e., comprises no non-synonymous substitutions at His-57, Asp-81, and/or Ser-139.

In some embodiments of any of the aspects, a polypeptide as described herein comprises a repressible protease that is catalytically inactive, i.e., dead. In regard to a repressible protease, "catalytically inactive" refers to the inability to cleave at a protease cleavage site. Accordingly, a catalytically inactive NS3 protease can comprise a nonsynonymous mutation at any one of His-57, Asp-81, and Ser-139. Non-limiting examples of NS3 inactivating mutations include H57A, D81A, S139A, or any combination thereof. As such, any one of SEQ ID NOs: 89-102 or SEQ ID NOs: 154-162 can comprise a H57A mutation; a D81A mutation; a S139A mutation; any nonsynonymous mutation to His-57, Asp-81, and Ser-139; or any combination thereof. In some embodiments of any of the aspects, any one of SEQ ID NOs: 89-102 or SEQ ID NOs: 154-162 can comprise a S139A mutation. In some embodiments of any of the aspects, a mutation to the catalytic triad does not disrupt other functions of the repressible protease, e.g., binding to a protease inhibitor, binding to a peptide domain, or binding to a reader domain.

In some embodiments of any of the aspects, a catalytically-inactive repressible protease of a polypeptide as described herein comprises SEQ ID NOs: 103 or 104, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 103 or 104 that maintains the same functions as SEQ ID NOs: 103 or 104 (e.g., catalytically inactive but still able to specifically bind to a protease inhibitor, reader domain, or peptide domain). In some embodiments of any of the aspects, a catalytically-inactive repressible protease of a polypeptide as described herein comprises SEQ ID NOs: 103 or 104, or an amino acid sequence that is at least 95% identical to the sequence of SEQ ID NOs: 103 or 104 that maintains the same functions as SEQ ID NOs: 103 or 104 (e.g., catalytically inactive).

In some embodiments of any of the aspects, the repressible protease of a polypeptide as described herein does not comprise at most the first (i.e., N-terminal) residues of SEQ ID NOs: 89-104. In some embodiments of any of the aspects, the repressible protease of a polypeptide as described herein comprises residues 1-180, 2-180, 3-180, 4-180, 5-180, 6-180, 7-180, 8-180, 9-180, 10-180, 11-180, 12-180, 13-180, 14-180, 15-180, 16-180, 17-180, 18-180, 19-180, 20-180, 21-180, 22-180, 23-180, 24-180, 25-180, 26-180, 27-180, 28-180, 29-180, or 30-180 of one of SEQ ID NOs: 89-104.

NS3 (genotype 1A), 189 aa; bold dotted underlined text indicates His-57 of the catalytic triad; _italicized double underlined text_ indicates Asp-81 of the catalytic triad; _bold italicized dotted underlined text_ indicates Ser-139 of the catalytic triad; zig zag underlined text indicates Asp-168.

SEQ ID NO: 89

APITAYAQQTRGLLGCIITSLTGRDKNQVEGEVQIVSTATQTFLATCINGVCWAVYHGAGTRTIASPK

GPVIQMYTNVDQ_D_LVGWPAPQGSRSLTPCTCGSSDLYLVTRHADVIPVRRRGDSRGSLLSPRPISYLK

GS_S_GGPLLCPAGHAVGLFRAAVCTRGVAKAVDFIPVENLETTMRSPVFTDNSS,

NS3 (genotype 1A), 180 aa (see e.g., residues 1027-1206 of Hepatitis C virus genotype 1 polyprotein, NCBI Reference Sequence: NP 671491.1.

SEQ ID NO: 90

APITAYAQQTRGLLGCIITSLTGRDKNQVEGEVQIVSTATQTFLATCINGVCWTVYHGAGTRTIASPK

GPVIQMYTNVDQDLVGWPAPQGSRSLTPCTCGSSDLYLVTRHADVIPVRRRGDSRGSLLSPRPISYLK

GSSGGPLLCPAGHAVGLFRAAVCTRGVAKAVDFIPVENLETTMR,

NS3 (genotype 1B), 180 aa (see e.g., residues 1-180 Chain A. Ns3 Protease, PDB: 4K8B_A)

SEQ ID NO: 91

APITAYSQQTRGLLGCIITSLTGRDKNQVEGEVQVVSTATQSFLATCVNGVCWTVYHGAGSKTLAGP

KGPITQMYTNVDQDLVGWQAPPGARSLTPCTCGSSDLYLVTRHADVIPVRRRGDSRGSLLSPRPVSY

LKGSSGGPLLCPSGHAVGIFRAAVCTRGVAKAVDFVPVESMETTMR,

```
NS3 (genotype 2), 180 aa (see e.g., residues 1031-1210 of Hepatitis C virus
genotype 2 polyprotein, NCBI Reference Sequence: YP_001469630.1
                                                          SEQ ID NO: 92
APITAYAQQTRGLLGTIVVSMTGRDKTEQAGEIQVLSTVTQSFLGTSISGVLWTVYHGAGNKTLAGS

RGPVTQMYSSAEGDLVGWPSPPGTKSLEPCTCGAVDLYLVTRNADVIPARRRGDKRGALLSPRPLST

LKGSSGGPVLCPRGHAVGVFRAAVCSRGVAKSIDFIPVETLDIVTR,

NS3 (genotype 3), 180 aa (see e.g., residues 1033-1212 of Hepatitis C virus
genotype 3 polyprotein, NCBI Reference Sequence: YP_001469631.1)
                                                          SEQ ID NO: 93
APITAYAQQTRGLLGTIVTSLTGRDKNVVTGEVQVLSTATQTFLGTTVGGVIWTVYHGAGSRTLAG

AKHPALQMYTNVDQDLVGWPAPPGAKSLEPCACGSSDLYLVTRDADVIPARRRGDSTASLLSPRPL

ACLKGSSGGPVMCPSGHVAGIFRAAVCTRGVAKSLQFIPVETLSTQAR,

NS3 (genotype 4), 180 aa (see e.g., residues 1027-1206 of Hepatitis C virus
genotype 4 polyprotein, NCBI Reference Sequence: YP_001469632.1)
                                                          SEQ ID NO: 94
APITAYAQQTRGLFSTIVTSLTGRDTNENCGEVQVLSTATQSFLGTAVNGVMWTVYHGAGAKTISGP

KGPVNQMYTNVDQDLVGWPAPPGVRSLAPCTCGSADLYLVTRHADVIPVRRRGDTRGALLSPRPISI

LKGSSGGPLLCPMGHRAGIFRAAVCTRGVAKAVDFVPVESLETTMR,

NS3 (genotype 5), 180 aa (see e.g., residues 1028-1207 of Hepatitis C virus
genotype 5 polyprotein, NCBI Reference Sequence: YP_001469633.1)
                                                          SEQ ID NO: 95
APITAYAQQTRGVLGAIVLSLTGRDKNEAEGEVQFLSTATQTFLGICINGVMWTLFHGAGSKTLAGP

KGPVVQMYTNVDKDLVGWPSPPGKGSLTRCTCGSADLYLVTRHADVIPARRRGDTRASLLSPRPISY

LKGSSGGPIMCPSGHVVGVFRAAVCTRGVAKALEFVPVENLETTMR,

NS3 (genotype 6), 180 aa (see e.g., residues 1032-1211 of Hepatitis C virus
genotype 6 polyprotein, NCBI Reference Sequence: YP_001469634.1)
                                                          SEQ ID NO: 96
APITAYAQQTRGLVGTIVTSLTGRDKNEAEGEVQVVSTATQSFLATTINGVLWTVYHGAGSKNLAGP

KGPVCQMYTNVDQDLVGWPAPLGARSLAPCTCGSSDLYLVTRGADVIPARRRGDTRAALLSPRPIST

LKGSSGGPLMCPSGHVVGLFRAAVCTRGVAKALDFIPVENMDTTMR,

NS3 (genotype 7), 180 aa (see e.g., residues 1031-1210 of Hepatitis C virus
genotype 7 polyprotein, NCBI Reference Sequence: YP_009272536.1)
                                                          SEQ ID NO: 97
APISAYAQQTRGLISTLVVSLTGRDKNETAGEVQVLSTSTQTFLGTNVGGVMWGPYHGAGTRTVAG

RGGPVLQMYTSVSDDLVGWPAPPGSKSLEPCSCGSADLYLVTRNADVLPLRRKGDTASLLSPRPVS

SLKGSSGGPVLCPQSHCVGIFRAAVCTRGVAKAVQFVPIEKMQVAQR,

NS3 genotype 1a (HCV-H), 180 aa
                                                          SEQ ID NO: 98
APITAYAQQTRGLLGCIITSLTGRDKNQVEGEVQIVSTATQTFLATCINGVCWTVYHGAGTRTIASPK

GPVIQMYTNVDQDLVGWPAPQGSRSLTPCTCGSSDLYLVTRHADVIPVRRRGDSRGSLLSPRPISYLK

GSSGGPLLCPAGHAVGLFRAAVCTRGVTKAVDFIPVENLETTMR,

NS3 genotype 1b (HCV-BK), 180 aa
                                                          SEQ ID NO: 99
APITAYSQQTRGLLGCIITSLTGRDKNQVEGEVQVVSTATQSFLATCVNGVCWTVYHGAGSKTLAAP

KGPITQMYTNVDQDLVGWPKPPGARSLTPCTCGSSDLYLVTRHADVIPVRRRGDSRGSLLSPRPVSY

LKGSSGGPLLCPFGHAVGIFRAAVCTRGVAKAVDFVPVESMETTMR,

NS3 genotype 2a (HCV-J6), 180 aa
                                                          SEQ ID NO: 100
APITAYAQQTRGLLGTIVVSMTGRDKTEQAGEIQVLSTVTQSFLGTTISGVLWTVYHGAGNKTLAGS

RGPVTQMYSSAEGDLVGWPSPPGTKSLEPCTCGAVDLYLVTRNADVIPARRRGDKRGALLSPRPLST

LKGSSGGPVLCPRGHAVGVFRAAVCSRGVAKSIDFIPVETLDIVTR,
```

```
NS3 genotype 2b (HCV-J8), 180 aa
                                                           SEQ ID NO: 101
APITAYTQQTRGLLGAIVVSLTGRDKNEQAGQVQVLSSVTQTFLGTSISGVLWTVYHGAGNKTLAGP

KGPVTQMYTSAEGDLVGWPSPPGTKSLDPCTCGAVDLYLVTRNADVIPVRRKDDRRGALLSPRPLS

TLKGSSGGPVLCSRGHAVGLFRAAVCARGVAKSIDFIPVESLDVATR,

NS3 genotype 3a (HCV-Nz11), 180 aa
                                                           SEQ ID NO: 102
APITAYAQQTRGLLGTIVTSLTGRDKNVVTGEVQVLSTATQTFLGTTVGGVIWTVYHGAGSRTLAG

AKHPALQMYTNVDQDLVGWPAPPGAKSLEPCACGSSDLYLVTRDADVIPARRRGDSTASLLSPRPL

ACLKGSSGGPVMCPSGHVAGIFRAAVCTRGVAKSLQFIPVETLSTQAR,

NS3 (genotype 1B; S139A), 179 aa; bold text indicates S139A.
                                                           SEQ ID NO: 103
ITAYSQQTRGLLGCIITSLTGRDKNQVEGEVQVVSTATQSFLATCVNGVCWTVYHGAGSKTLAGPK

GPITQMYTNVDQDLVGWQAPPGARSLTPCTCGSSDLYLVTRHADVIPVRRRGDSRGSLLSPRPVSYL

KGSAGGPLLCPSGHAVGIFRAAVCTRGVAKAVDFVPVESMETTMRS,

NS3 (genotype 1A; S139A),189 aa; bold text indicates S139A.
                                                           SEQ ID NO: 104
APITAYAQQTRGLLGCIITSLTGRDKNQVEGEVQIVSTATQTFLATCINGVCWAVYHGAGTRTIASPK

GPVIQMYTNVDQDLVGWPAPQGSRSLTPCTCGSSDLYLVTRHADVIPVRRRGDSRGSLLSPRPISYLK

GSAGGPLLCPAGHAVGLFRAAVCTRGVAKAVDFIPVENLETTMRSPVFTDNSS,
```

In some embodiments of any of the aspects, the polypeptide further comprising a cofactor for the repressible protease. As used herein the term "cofactor for the repressible protease" refers to a molecule that increases the activity of the repressible protease. In some embodiments of any of the aspects, a polypeptide as described herein comprises 1, 2, 3, 4, 5, or more cofactors for the repressible protease. In some embodiments of any of the aspects, the polypeptide comprises one cofactor for each repressible protease. In embodiments comprising multiple cofactors for the repressible protease, the multiple cofactors for the repressible protease can be different individual cofactors or multiple copies of the same cofactor, or a combination of the foregoing.

In some embodiments of any of the aspects, the cofactor is an HSV NS4A domain, and the repressible protease is HSV NS3. The nonstructural protein 4a (NS4A) is the smallest of the nonstructural HCV proteins. The NS4A protein has multiple functions in the HCV life cycle, including (1) anchoring the NS3-4A complex to the outer leaflet of the endoplasmic reticulum and mitochondrial outer membrane, (2) serving as a cofactor for the NS3A serine protease, (3) augmenting NS3A helicase activity, and (4) regulating NS5A hyperphosphorylation and viral replication. The interactions between NS4A and NS4B control genome replication and between NS3 and NS4A play a role in virus assembly.

In some embodiments of any of the aspects, a polypeptide as described herein comprises the portion of the NS4a polypeptide that serves as a cofactor for NS3. Deletion analysis has shown that the central region (approximately residues 21 to 34) of the 54-residue NS4A protein is essential and sufficient for the cofactor function of the NS3 serine protease. Accordingly, in some embodiments of any of the aspects, the repressible protease cofactor comprises a 14-residue region of the wildtype NS4A protein.

In some embodiments of any of the aspects, the cofactor for the repressible protease can be an HCV genotype 1 NS4A, an HCV genotype 1a NS4A, an HCV genotype 1b NS4A, an HCV genotype 2 NS4A, an HCV genotype 2a NS4A, an HCV genotype 2b NS4A, an HCV genotype 3 NS4A, an HCV genotype 3a NS4A, an HCV genotype 3b NS4A, an HCV genotype 4 NS4A, an HCV genotype 4a NS4A, an HCV genotype 4b NS4A, an HCV genotype 5 NS4A, an HCV genotype 5a NS4A, an HCV genotype 5b NS4A, an HCV genotype 6 NS4A, an HCV genotype 6a NS4A, an HCV genotype 6b NS4A, an HCV genotype 7 NS4A, an HCV genotype 7a NS4A, or an HCV genotype 7b NS4A. In some embodiments of any of the aspects, the cofactor for the repressible protease can be any known NS4A genotype, variant, or mutant, e.g., that maintains the same function. In some embodiments of any of the aspects, the NS4A sequence comprises residues 21-31 of the NS4A protein from HCV-H, HCV-1, HCV-J1, HCV-BK, HCV-JK1, HCV-J4, HCV-J, HCV-J6, C14112, HCV-J8, D14114, HCV-Nz11, or HCV-K3a (see e.g., Chao Lin 2006 supra; see e.g., Table 11).

In some embodiments of any of the aspects, the cofactor for a repressible protease of a polypeptide as described herein comprises one of SEQ ID NOs: 105-128, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 105-128 that maintains the same function. In some embodiments of any of the aspects, the cofactor for a repressible protease of a polypeptide as described herein comprises one of SEQ ID NOs: 105-128, or an amino acid sequence that is at least 95% identical to the sequence of one of SEQ ID NOs: 105-128 that maintains the same function.

In some embodiments of any of the aspects, the cofactor for the repressible protease of a polypeptide as described herein comprises residues 1-14, 1-13, 1-12, 1-11, 1-10, 2-14, 2-13, 2-12, 2-11, 2-10, 3-14, 3-13, 3-12, 3-11, 3-10, 4-14, 4-13, 4-12, 4-11, or 4-10 of any of SEQ ID NOs: 105-128.

SEQ ID NO: 105, NS4A (genotype 1A), 13 aa, GCV-VIVGRIVLSG

SEQ ID NO: 106, NS4A (genotype 1A), 39 nt GGCTGCGTGGTCATAGTGGGCAG-GATCGTCTTGTCCGGA SEQ ID NO: 107, NS4A (genotype 1B), 36 nt GGTCTGTGTATGTGGTAGAATATITTATCT SEQ ID NO: 108, NS4A (genotype 1B), 12 aa, GSV-VIVGRIILS; see e.g., Chain C, Nonstructural Protein, PDB: 4K8B_C.

SEQ ID NO: 109, NS4A (genotype 1), 14 aa (see e.g., residues 1678-1691 of Hepatitis C virus genotype 1 polyprotein, NCBI Reference Sequence: NP_671491.1): GCV-VIVGRIVLSGK SEQ ID NO: 110, NS4A (genotype 2), 14 aa (see e.g., residues 1682-1695 of Hepatitis C virus genotype 2 polyprotein, NCBI Reference Sequence: YP_001469630.1: GCVCIIGRLHINQR SEQ ID NO: 111, NS4A (genotype 3), 14 aa (see e.g., residues 1684-1697 of Hepatitis C virus genotype 3 polyprotein, NCBI Reference Sequence: YP_001469631.1): GCVVIVGHIELEGK SEQ ID NO: 112, NS4A (genotype 4), 14 aa (see e.g., residues 1678-1691 of Hepatitis C virus genotype 4 polyprotein, NCBI Reference Sequence: YP_001469632.1): GSVVIVGRVVLSGQ SEQ ID NO: 113, NS4A (genotype 5), 14 aa (see e.g., residues 1679-1692 of Hepatitis C virus genotype 5 polyprotein, NCBI Reference Sequence: YP_001469633.1): GSVAIVGRIILSGR SEQ ID NO: 114, NS4A (genotype 6), 14 aa (see e.g., residues 1683-1696 of Hepatitis C virus genotype 6 polyprotein, NCBI Reference Sequence: YP_001469634.1): GCVVICGRIVTSGK SEQ ID NO: 115, NS4A (genotype 7), 14 aa (see e.g., residues 1682-1695 of Hepatitis C virus genotype 7 polyprotein, NCBI Reference Sequence: YP_009272536.1): GSVVVVGRVVLGSN In some embodiments of any of the aspects, the NS4A sequence is selected from Table 11. In one embodiment, the NS4A comprises residues 21-31 of one of SEQ ID NOs: 116-128 or a sequence that is at least 70% identical.

TABLE 11

Exemplary NS4A sequences (see e.g., Chao Lin 2006 supra). Residues 21-31 are bolded.

| SEQ ID NO | Genotype (strain) | Sequence |
|---|---|---|
| 116 | 1a (HCV-H) | STWVL VGGVL AALAA YCLST GCVVI VGRIV LSGKP AIIPD REVLY QEFDE MEEC |
| 117 | 1a (HCV-1) | STWVL VGGVL AALAA YCLST GCVVI VGRVV LSGKP AIIPD REVLY REFDE MEEC |
| 118 | 1a (HCV-J1) | STWVL VGGVL AALAA YCLST GCVVI VGRIV LSGRP AIIPD REVLY REFDE MEEC |
| 119 | 1b (HCV-BK) | STWVL VGGVL AALAA YCLTT GSVVI VGRII LSGRP AIVPD RELLY QEFDE MEEC |
| 120 | 1b (HCV-JK1) | STWVL VGGVL AALAA YCLTT GSVVI VGRII LSGRP AIVPD RELLY QEFDE MEEC |

TABLE 11-continued

Exemplary NS4A sequences (see e.g., Chao Lin 2006 supra). Residues 21-31 are bolded.

| SEQ ID NO | Genotype (strain) | Sequence |
|---|---|---|
| 121 | 1b (HCV-J4) | STWVL VGGVL AALAA YCLTT GSVVI VGRII LSGKP AVVPD RELLY QEFDE MEEC |
| 122 | 1b (HCV-J) | STWVL VGGVL AALAA YCLTT GSVVI VGRII LSGRP AVIPD RELLY REFDE MEEC |
| 123 | 2a (HCV-J6) | STWVL AGGVL AAVAA YCLAT GCVCI IGRLH VNQRA VVAPD KEVLY EAFDE MEEC |
| 124 | 2a (D14112) | STWVL AGGVL AAVAA YCLAT GCVSI IGRLH INGRA VVAPD KEVLY EAFDE MEEC |
| 125 | 2b (HCV-J8) | SSWVL AGGVL AAVAA YCLAT GCISI IGRLH LNDRV VVAPD KEILY EAFDE MEEC |
| 126 | 2b (D14114) | STWVL AGGVL AAVAA YCLAT GCVSI IGRLH LNDQV VVTPD KEILY EAFDE MEEC |
| 127 | 3a (HCV-Nz11) | STWVL LGGVL AALAA YCLSV GCVVI VGHIE LEGKP ALVPD KEVLY QQYDE MEEC |
| 128 | 3a (HCV-K3a) | STWVL LGGVL AAVAA YCLSV GCVVI VGHIE LGGKP ALVPD KEVLY QQYDE MEEC |

In some embodiments of any of the aspects, a polypeptide as described herein can comprise any combination of NS3 and NS4A genotypes, variants, or mutants as described herein. In one embodiment, the NS3 and NS4A are selected from selected from the same genotype as each other. In some embodiments of any of the aspects, the NS3 is genotype 1a and the NS4A is genotype 1b. In some embodiments of any of the aspects, the NS3 is genotype 1b and the NS4A is genotype 1a.

In some embodiments of any of the aspects, a polypeptide as described herein comprises an HSV NS4A domain adjacent to the NS3 repressible protease. In some embodiments of any of the aspects, the NS4A domain is N-terminal of the NS3 repressible protease. In some embodiments of any of the aspects, the NS4A domain is C-terminal of the NS3 repressible protease. In some embodiments of any of the aspects, the polypeptide comprises a linker between the NS4A domain and the NS3 repressible protease. Non-limiting examples of linker (e.g., between the NS4A domain and the NS3 repressible protease) include: SGTS (SEQ ID NO: 129) and GSGS (SEQ ID NO: 130).

In some embodiments of any of the aspects, any two domains as described herein in a polypeptide can be joined into a single polypeptide by positioning a peptide linker, e.g., a flexible linker between them. As used herein "peptide linker" refers to an oligo- or polypeptide region from about 2 to 100 amino acids in length, which links together any of the sequences of the polypeptides as described herein. In some embodiment, linkers can include or be composed of flexible residues such as glycine and serine so that the adjacent protein domains are free to move relative to one another. Longer linkers may be used when it is desirable to ensure that two adjacent domains do not sterically interfere with one another. Linkers may be cleavable or non-cleavable.

In some embodiments of any of the aspects, the first or second polypeptide does not comprise any protease cleavage sites. In some embodiments of any of the aspects, the first or second polypeptide comprises at least one protease cleavage sites. As used herein, the term "protease cleavage site" refers to a specific sequence or sequence motif recognized by and cleaved by the repressible protease. A cleavage site for a protease includes the specific amino acid sequence or motif recognized by the protease during proteolytic cleavage and typically includes the surrounding one to six amino acids on either side of the scissile bond, which bind to the active site of the protease and are used for recognition as a substrate. In some embodiments of any of the aspects, the protease cleavage site can be any site specifically bound by and cleaved by the repressible protease. In some embodiments of any of the aspects, a polypeptide as described herein (or the polypeptide system collectively) comprises 1, 2, 3, 4, 5, or more protease cleavage sites. In some embodiments of any of the aspects, the polypeptide comprises two protease cleavage sites. In embodiments comprising multiple protease cleavage sites, the multiple protease cleavage sites can be different individual protease cleavage sites or multiple copies of the same protease cleavage sites, or a combination of the foregoing.

As a non-limiting example, during HCV replication, the NS3-4A serine protease is responsible for the proteolytic cleavage at four junctions of the HCV polyprotein precursor: NS3/NS4A (self-cleavage), NS4A/NS4B, NS4B/NS5A, and NS5A/NS5B. Accordingly, the protease cleavage site of a polypeptide as described herein can be a NS3/NS4A cleavage site, a NS4A/NS4B cleavage site, a NS4B/NS5A cleavage site, or a NS5A/NS5B cleavage site. The protease cleavage site can be a protease cleavage sites from HCV genotype 1, genotype 1a, genotype 1b, genotype 2, genotype 2a, genotype 2b, genotype 3, genotype 3a, genotype 3b, genotype 4, genotype 4a, genotype 4b, genotype 5, genotype 5a, genotype 5b, genotype 6, genotype 6a, genotype 6b, genotype 7, genotype 7a NS4A, or genotype 7b. In some embodiments of any of the aspects, the protease cleavage site can be any known NS3/NS4A protease cleavage site or variant or mutant thereof, e.g., that maintains the same function. In some embodiments of any of the aspects, the NS4A sequence comprises residues 21-31 of the NS4A protein from HCV-H, HCV-1, HCV-J1, HCV-BK, HCV-JK1, HCV-J4, HCV-J, HCV-J6, C14112, HCV-J8, D14114, HCV-Nz11, or HCV-K3a (see e.g., Chao Lin 2006 supra).

In some embodiments of any of the aspects, the protease cleavage site of a polypeptide as described herein comprises one of SEQ ID NOs: 131-152, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 131-152 that maintains the same functions as. In some embodiments of any of the aspects, the protease cleavage site of a polypeptide as described herein comprises SEQ ID NOs: 131-152, or an amino acid sequence that is at least 95% identical to the sequence of one of SEQ ID NOs: 131-152 that maintains the same functions.

In some embodiments of any of the aspects, the protease cleavage site of a polypeptide as described herein comprises residues 1-20, 1-19, 1-18, 1-17, 1-16, 1-15, 2-20, 2-19, 2-18, 2-17, 2-16, 2-15, 3-20, 3-19, 3-18, 3-17, 3-16, 3-15, 4-20, 4-19, 4-18, 4-17, 4-16, 4-15, 5-20, 5-19, 5-18, 5-17, 5-16, or 5-15, of any of SEQ ID NOs: 131-152.

SEQ ID NO: 131, NS5A/5B cut site (CC), 10 aa, EDVVCCHSIY

SEQ ID NO: 132, NS4A/4B cut site (CS), 14 aa, LYQEFDEMEECSQH

TABLE 12

Exemplary NS3/NS4A protease cleavage sites (see e.g., Chao Lin 2006 supra).

| Cleavage Site Type | SEQ ID NO | Genotype (Strain) | Sequence (cleavage site shown with space) |
|---|---|---|---|
| NS3/NS4A | 133 | 1a (HCV-H) | CMSADLEVVT STWVLVGGVL |
|  | 134 | 1b (HCV-BK) | CMSADLEVVT STWVLVGGVL |
|  | 135 | 2a (HCV-J6) | CMQADLEVMT STWVLAGGVL |
|  | 136 | 2b (HCV-J8) | CMQADLEIMT SSWVLAGGVL |
|  | 137 | 3a (HCV-Nz11) | CMSADLEVTT STWVLLGGVL |
| NS4A/NS4B | 138 | 1a (HCV-H) | YQEFDEMEEC SQHLPYIEQG |
|  | 139 | 1b (HCV-BK) | YQEFDEMEEC ASHLPYIEQG |
|  | 140 | 2a (HCV-J6) | YEAFDEMEEC ASRAALIEEG |
|  | 141 | 2b (HCV-J8) | YEAFDEMEEC ASKAALIEEG |
|  | 142 | 3a (HCV-Nz11) | YQQYDEMEEC SQAAPYIEQA |
| NS4B/NS5A | 143 | 1a (HCV-H) | WISSECTTPC SGSWLRDVWD |
|  | 144 | 1b (HCV-BK) | WINEDCSTPC SGSWLRDVWD |
|  | 145 | 2a (HCV-J6) | WITEDCPIPC SGSWLRDVWD |
|  | 146 | 2b (HCV-J8) | WITEDCPVPC SGSWLQDIWD |
|  | 147 | 3a (HCV-Nz11) | WINEDYPSPC SDDWLRTIWD |
| NS5A/NS5B | 148 | 1a (HCV-H) | GADTEDVVCC SMSYSWTGAL |
|  | 149 | 1b (HCV-BK) | EEASEDVVCC SMSYTWTGAL |
|  | 150 | 2a (HCV-J6) | SEEDDSVVCC SMSYSWTGAL |
|  | 151 | 2b (HCV-J8) | SDQEDSVICC SMSYSWTGAL |
|  | 152 | 3a (HCV-Nz11) | DSEEQSVVCC SMSYSWTGAL |

In some embodiments of any of the aspects, a polypeptide as described herein comprises two protease cleavage sites, with one N-terminal of the NS3-NS4A complex, and the other C-terminal of the NS3-NS4A complex (see e.g., Table 13). In some embodiments of any of the aspects, the two protease cleavage sites can be the same cleavage sites or different cleavage sites.

TABLE 13

Exemplary Protease Cleavage Site Combinations.

| N | 3/4A | | | | 4A/4B | | | |
|---|---|---|---|---|---|---|---|---|
| C | 3/4A | 4A/4B | 4B/5A | 5A/5B | 3/4A | 4A/4B | 4B/5A | 5A/5B |
| N | | 4B/5A | | | | 5A/5B | | |
| C | 3/4A | 4A/4B | 4B/5A | 5A/5B | 3/4A | 4A/4B | 4B/5A | 5A/5B |

"N" indicates N-terminal of the NS3-NS4A complex. "C" indicates C-terminal of the NS3-NS4A complex. "3/4A" indicates the NS3/NS4A cleavage site. "4A/4B" indicates the NS4A/NS4B cleavage site. "4B/5A" indicates the NS4B/NS5A cleavage site. "5A/5B" indicates the NS5A/NS5B cleavage site.

In some embodiments of any of the aspects, a polypeptide as described herein comprise any known genotypes, variants, or mutants of NS3/NS4A, NS4A/NS4B, NS4B/NS5A, and NS5A/NS5B cleavage sites. In one embodiment, the twopotas cleavage sites are selected from selected from the same genotype as each other.

In some embodiments of any of the aspects, the protease cleavage site is located or engineered such that, when the polypeptide cleaves its target (e.g., itself or another polypeptide comprising at protease cleavage site) using the repressible protease in the absence of aprotease inhibitor, the resulting amino acid at the N-terminus of the newly cleaved polypeptide(s) causes the polypeptide(s) to degrade at a faster rate and have a shorter half-life compared to other cleaved polypeptides. According to the N-end rule, newly cleaved polypeptides comprising the amino acid His, Tyr, Gln, Asp, Asn, Phe, Leu, Trp, Lys, or Arg at the N-terminus exhibit a high degradation rate and a short half-life (e.g., 10 minutes or less in yeast; 1-5.5 hours in mammalian reticulocytes). Comparatively, newly cleaved polypeptides comprising the amino acid Val, Met, Gly, Pro, Ala, Ser, Thr, Cys, Ile, or Glu at the N-terminus exhibit a lower degradation rate and a longer half-life (e.g., 30 minutes or more in yeast; 1-100 hours in mammalian reticulocytes). See e.g., Gonda et al., Universality and Structure of the N-end Rule, The Journal of Biological Chemistry, Vol. 264 (28), pp. 16700-16712, 1989, the content of which is incorporated herein by reference in its entirety. Accordingly, in some embodiments of any of the aspects, the resulting amino acid at the N-terminus of a newly cleaved polypeptide as described herein is His, Tyr, Gln, Asp, Asn, Phe, Leu, Trp, Lys, or Arg. In some embodiments of any of the aspects, the resulting amino acid at the N-terminus of the newly cleaved polypeptide as described herein is not Val, Met, Gly, Pro, Ala, Ser, Thr, Cys, Ile, or Glu.

In some embodiments of any of the aspects, the N-terminus of a newly cleaved polypeptide as described herein comprises SEQ ID NO: 153 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 153 that maintains a His or another highly degraded amino acid at the N-terminus. In some embodiments of any of the aspects, the N-terminus of a newly cleaved polypeptide as described herein comprises SEQ ID NO: 153 or an amino acid sequence that is at least 95% identical to the sequence of SEQ ID NO: 153 that maintains the same function.

SEQ ID NO: 153, N-end rule, 8 aa, HSIYGKKK

In some embodiments of any of the aspects, a polypeptide as described herein is in combination with a protease inhibitor. As used herein, "in combination with" refers to two or more substances being present in the same formulation in any molecular or physical arrangement, e.g., in an admixture, in a solution, in a mixture, in a suspension, in a colloid, in an emulsion. The formulation can be a homogeneous or heterogeneous mixture. In some embodiments of any of the aspects, the active compound(s) can be comprised by a superstructure, e.g., nanoparticles, liposomes, vectors, cells, scaffolds, or the like, said superstructure is which in solution, mixture, admixture, suspension, etc., with the polypeptide or polypeptide system. In some embodiments of any of the aspects, the polypeptide is bound to a protease inhibitor bound to the repressible protease. In some embodiments of any of the aspects, the polypeptide is bound specifically to a protease inhibitor bound to the repressible protease.

In some embodiments of any of the aspects, the polypeptide or system is in combination with 1, 2, 3, 4, 5, or more protease inhibitors. In some embodiments of any of the aspects, the polypeptide or system is in combination with one protease inhibitor. In embodiments comprising multiple protease inhibitors, the multiple protease inhibitors can be different individual protease inhibitors or multiple copies of the same protease inhibitor, or a combination of the foregoing.

In some embodiments of any of the aspects, the protease inhibitor is grazoprevir (abbreviated as GZV or GZP; see e.g., PubChem CID: 44603531). In some embodiments of any of the aspects, the protease inhibitor is danoprevir (DNV; see e.g., PubChem CID: 11285588). In some embodiments of any of the aspects, the protease inhibitor is an approved NS3 protease inhibitor, such as but not limited to grazoprevir, danoprevir, simeprevir, asunaprevir, ciluprevir, boceprevir, sovaprevir, paritaprevir, ombitasvir, paritaprevir, ritonavir, dasabuvir, and telaprevir. Additional non-limiting examples of NS3 protease inhibitors are listed in Table 14 (see e.g., McCauley and Rudd, Hepatitis C virus NS3/4a protease inhibitors, Current Opinion in Pharmacology 2016, 30:84-92; the content of which is incorporated herein by reference in its entirety).

TABLE 14

Exemplary NS3/NS4A protease inhibitors

| Description or Name(s) | Structure |
|---|---|
| The N-terminal hexapeptide product of substrate cleavage (e.g., DDIVPC-OH) | 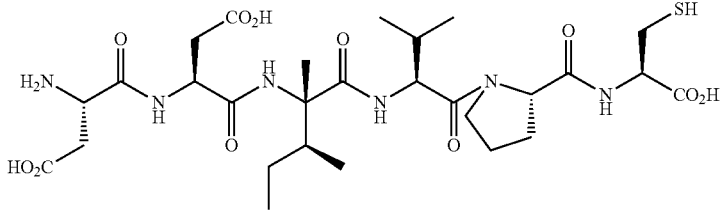 [SMILES: CC[C@H](C)[C@](C)(NC(=O)[C@H](CC(=O)O)NC(=O)[C@@H](N)CC(=O)O)C(=O)N[C@H](C(=O)N1CCC[C@H]1C(=O)N[C@@H](CS)C(=O)O)C(C)C] 1 |
| One of the products of cleavage of the NS4a-NS4b peptide (e.g., Ac-DEMEEC-OH) | 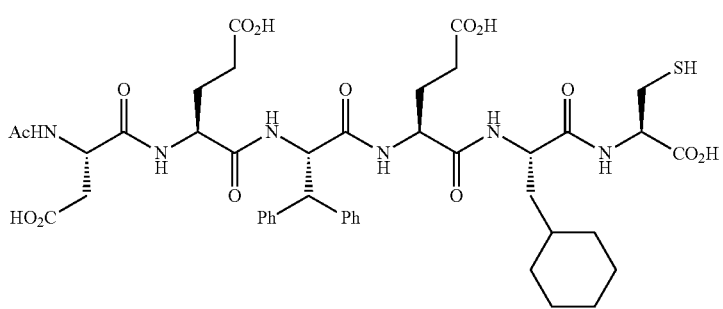 [SMILES: CC(=O)N[C@@H](CC(=O)O)C(=O)N[C@@H](CCC(=O)O)C(=O)N[C@H](C(=O)N[C@@H](CCC(=O)O)C(=O)N[C@@H](CC1CCCCC1)C(=O)N[C@@H](CS)C(=O)O)C(c1ccccc1)c1ccccc1] 2 |

TABLE 14-continued

Exemplary NS3/NS4A protease inhibitors

| Description or Name(s) | Structure |
|---|---|
| VICTRELIS ™ boceprevir SCH503034 | 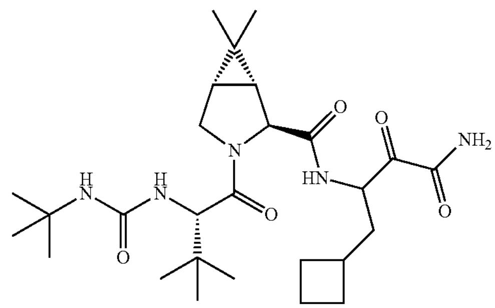 [SMILES: CC(C)(C)NC(=O)N[C@H](C(=O)N1C[C@H]2[C@@H]([C@H]1C(=O)NC(CC1CCC1)C(=O)C(N)=O)C2(C)C)C(C)(C)C] |
| INCIVEK ™, INCIVIO ™, telaprevir, VX-950 | 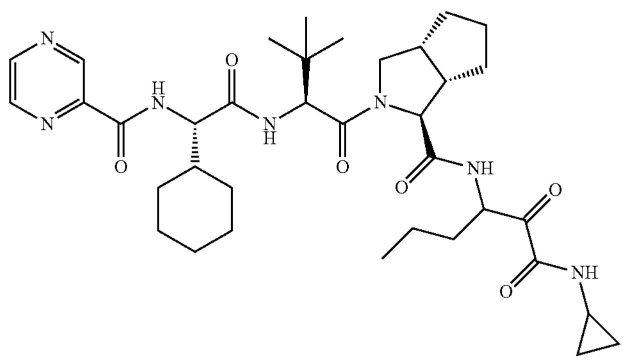 [SMILES: CCCC(NC(=O)[C@@H]1[C@H]2CCC[C@H]2CN1C(=O)[C@@H](NC(=O)[C@@H](NC(=O)c1cnccn1)C1CCCCC1)C(C)(C)C)C(=O)C(=O)NC1CC1] |
| Ciluprevir; BILN-2061 | 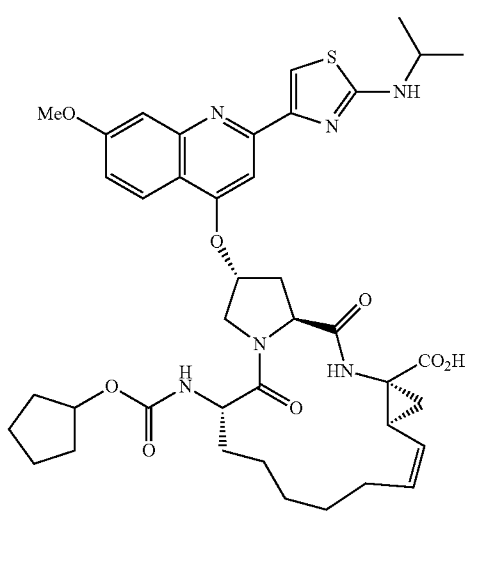 [SMILES: COc1ccc2c(O[C@@H]3C[C@H]4C(=O)N[C@]5(C(=O)O)C[C@H]5/C=C\CCCCC[C@H](NC(=O)OC5CCCC5)C(=O)N4C3)cc(-c3csc(NC(C)C)n3)nc2c1] |

TABLE 14-continued
Exemplary NS3/NS4A protease inhibitors
| Description or Name(s) | Structure |
|---|---|
| BMS-605339 | 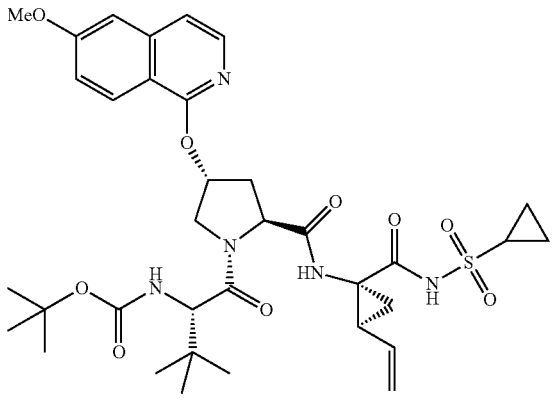 |
| MK-4519 | 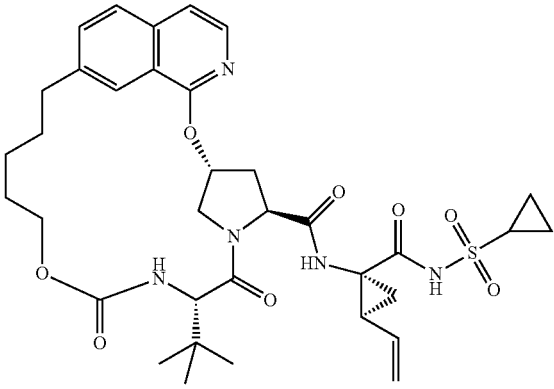 [SMILES: C=C[C@@H]1C[C@]1(NC(=O)[C@@H]1C[C@@H]2CN1C(=O)[C@H](C(C)(C)C)NC(=O)OCCCCCc1ccc3ccnc(c3c1)O2)C(=O)NS(=O)(=O)C1CC1] |
| faldaprevir, BI-201335 | 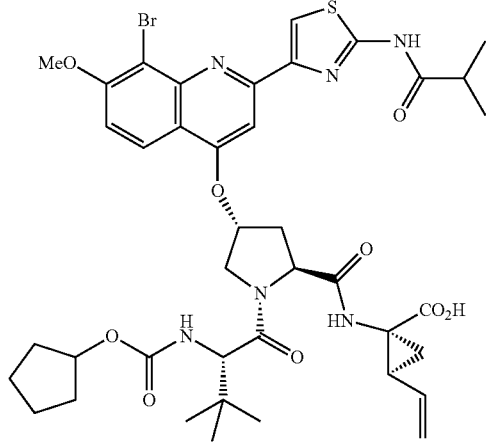 |

TABLE 14-continued

Exemplary NS3/NS4A protease inhibitors

| Description or Name(s) | Structure |
|---|---|
| Danoprevir, ITMN-191, R7227 | 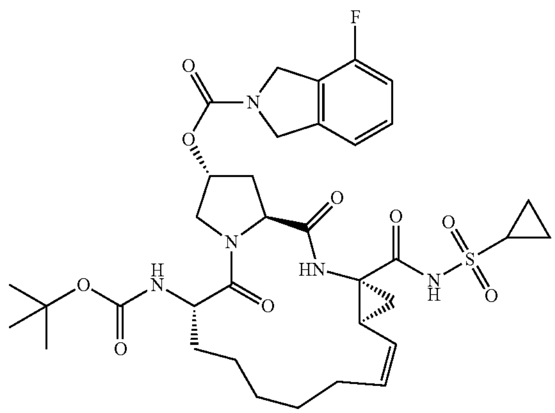 [SMILES: CC(C)(C)OC(=O)N[C@H]1CCCCC/C=C\[C@@H]2C[C@@]2(C(=O)NS(=O)(=O)C2CC2)NC(=O)[C@@H]2C[C@@H](OC(=O)N3Cc4cccc(F)c4C3)CN2C1=O] |
| SUNVEPRA ™, asunaprevir, BMS-650032 | 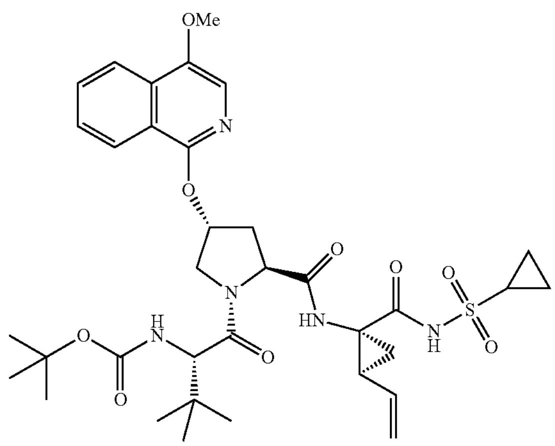 |
| VANIHEP ™, vaniprevir, MK-7009 | 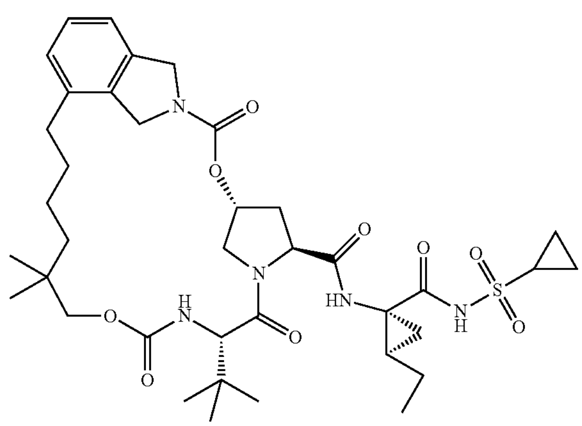 [SMILES: CC[C@@H]1C[C@]1(NC(=O)[C@@H]1C[C@@H]2CN1C(=O)[C@H](C(C)(C)C)NC(=O)OCC(C)(C)CCCCc1cccc3c1CN(C3)C(=O)O2)C(=O)NS(=O)(=O)C1CC1] |

TABLE 14-continued

Exemplary NS3/NS4A protease inhibitors

| Description or Name(s) | Structure |
| --- | --- |
| OLYSIO™ simeprevir, TMC-435350 | 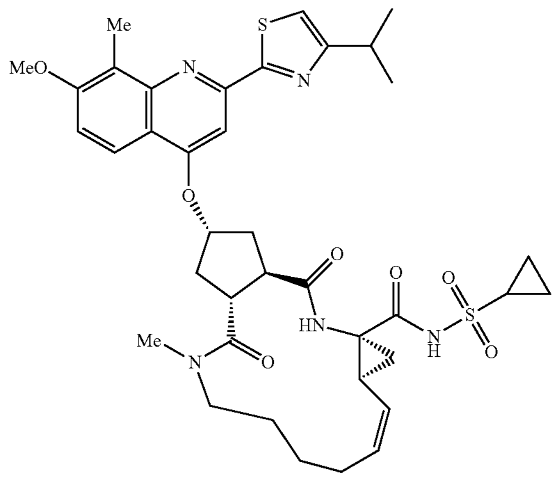 [SMILES: COc1ccc2c(O[C@@H]3C[C@H]4C(=O)N[C@]5(C(=O)NS(=O)(=O)C6CC6)C[C@H]5/C=C\CCCCN(C)C(=O)[C@@H]4C3)cc(-c3nc(C(C)C)cs3)nc2c1C] |
| Sovaprevir, ACH-1625 | 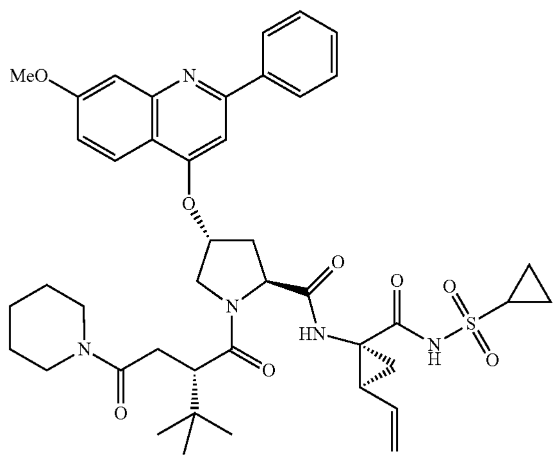 [SMILES: C=C[C@@H]1C[C@]1(NC(=O)[C@@H]1C[C@@H](Oc2cc(-c3ccccc3)nc3cc(OC)ccc23)CN1C(=O)[C@@H](CC(=O)N1CCCCC1)C(C)(C)C)C(=O)NS(=O)(=O)C1CC1] |
| Deldeprevir/neceprevir, ACH-2684 | 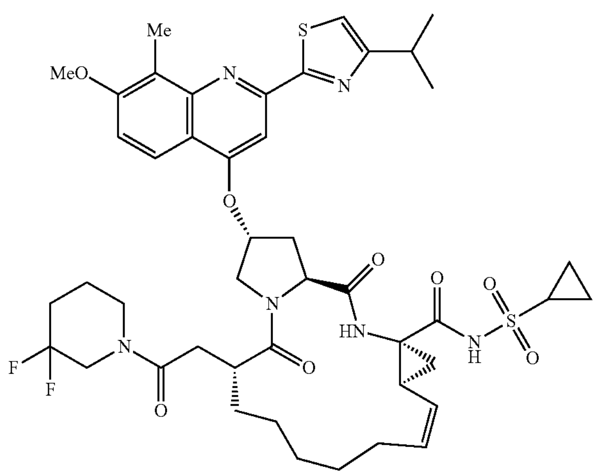 [SMILES: COc1ccc2c(O[C@@H]3C[C@H]4C(=O)N[C@]5(C(=O)NS(=O)(=O)C6CC6)C[C@H]5/C=C\CCCCC[C@H](CC(=O)N5CCCC(F)(F)C5)C(=O)N4C3)cc(-c3nc(C(C)C)cs3)nc2c1C] |

TABLE 14-continued
Exemplary NS3/NS4A protease inhibitors
| Description or Name(s) | Structure |
|---|---|
| IDX320 | 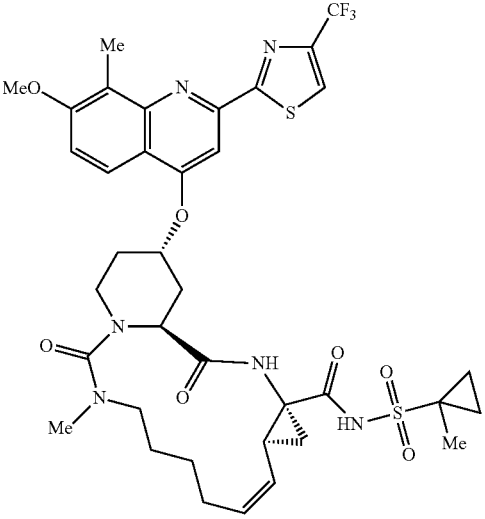 [SMILES: COc1ccc2c(O[C@H]3CCN4C(=O)N(C)CCCC/C=C\[C@@H]5C[C@@]5(C(=O)NS(=O)(=O)C5(C)CC5)NC(=O)[C@@H]4C3)cc(-c3nc(C(F)(F)F)cs3)nc2c1C] |
| GS-9256 | 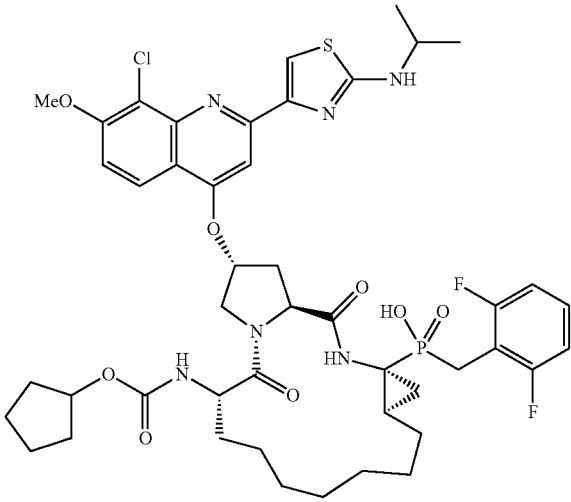 |
| PHX1766 | 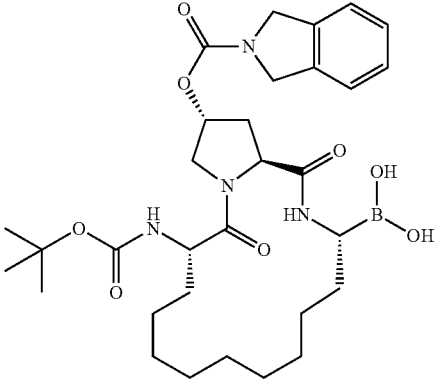 [SMILES: CC(C)(C)OC(=O)N[C@H]1CCCCCCCCC[C@@H](B(O)O)NC(=O)[C@@H]2C[C@@H](OC(=O)N3Cc4ccccc4C3)CN2C1=O] |

TABLE 14-continued

Exemplary NS3/NS4A protease inhibitors

| Description or Name(s) | Structure |
| --- | --- |
| MK-2748 | 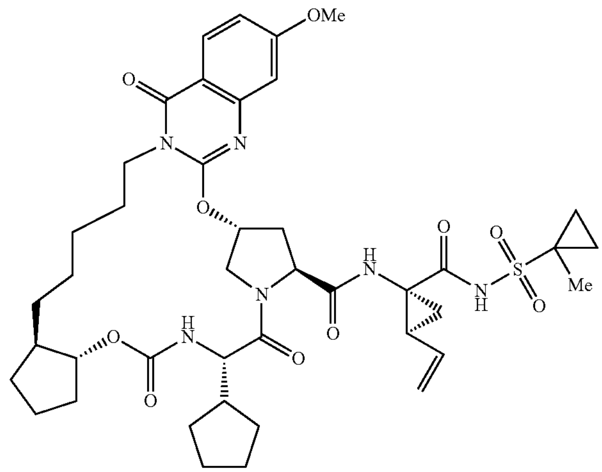 [SMILES: C=C[C@@H]1C[C@]1(NC(=O)[C@@H]1C[C@@H]2CN1C(=O)[C@H](C1CCCC1)NC(=O)O[C@@H]1CCC[C@H]1CCCCCn1c(nc3cc(OC)ccc3c1=O)O2)C(=O)NS(=O)(=O)C1(C)CC1] |
| Vedrorevir, GS-9451, GS-9451 | 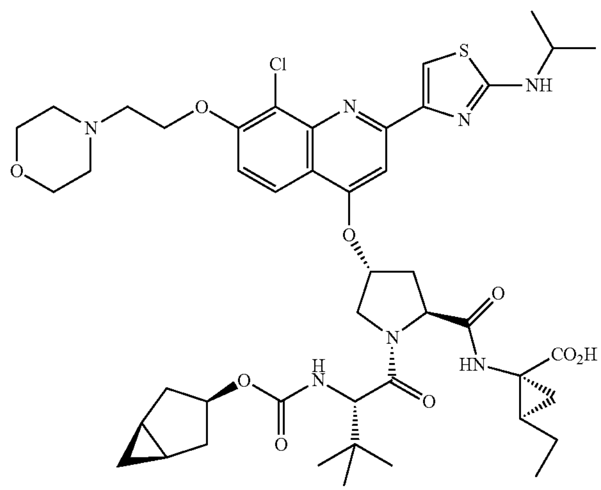 |
| MK-6325 | 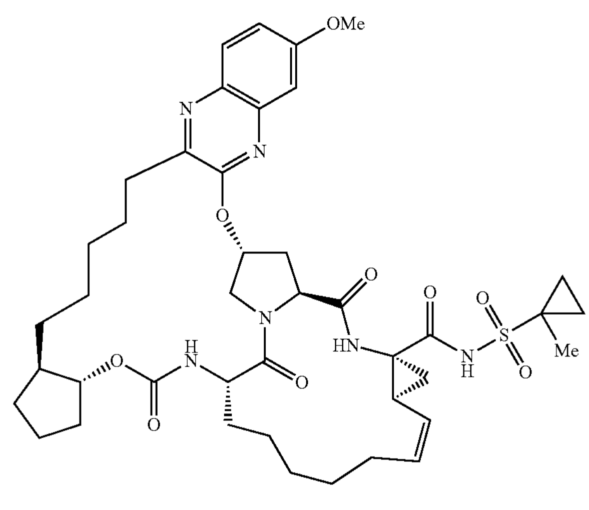 [SMILES: COc1ccc2nc3c(nc2c1)O[C@@H]1C[C@H]2C(=O)N[C@]4(C(=O)NS(=O)(=O)C5(C)CC5)C[C@H]4/C=C\CCCCC[C@H](NC(=O)O[C@@H]4CCC[C@H]4CCCCC3)C(=O)N2C1] |

//

TABLE 14-continued

Exemplary NS3/NS4A protease inhibitors

| Description or Name(s) | Structure |
|---|---|
| MK-8831 | 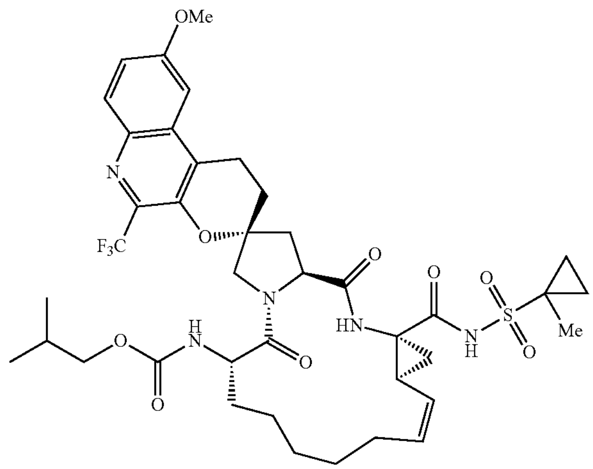 |
| VIKERA PAK ™, paritaprevir, ABT-450 | 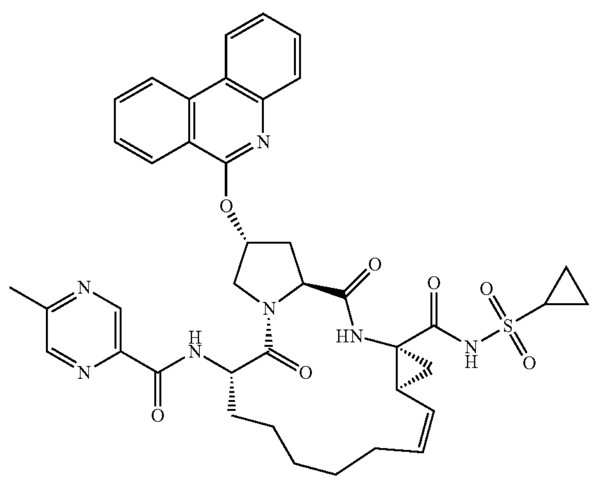 |
| ZEPATIER ™, grazoprevir, MK-5172 | 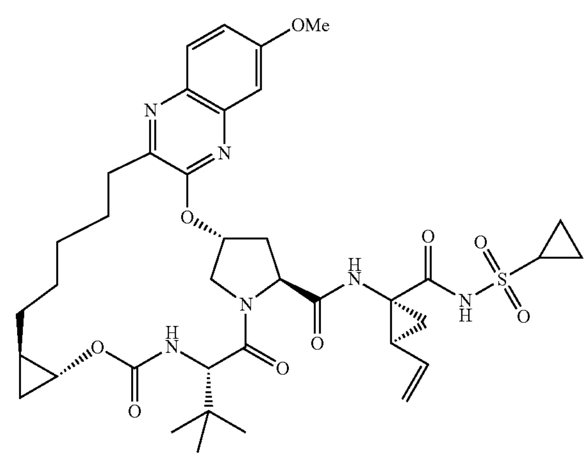 [SMILES: C=C[C@@H]1C[C@]1(NC(=O)[C@@H]1C[C@@H]2CN1C(=O)[C@H](C(C)(C)C)NC(=O)O[C@@H]1C[C@H]1CCCCCc1nc3ccc(OC)cc3nc1O2)C(=O)NS(=O)(=O)C1CC1] |

TABLE 14-continued

Exemplary NS3/NS4A protease inhibitors

| Description or Name(s) | Structure |
|---|---|
| Glecaprevir, ABT-493 | 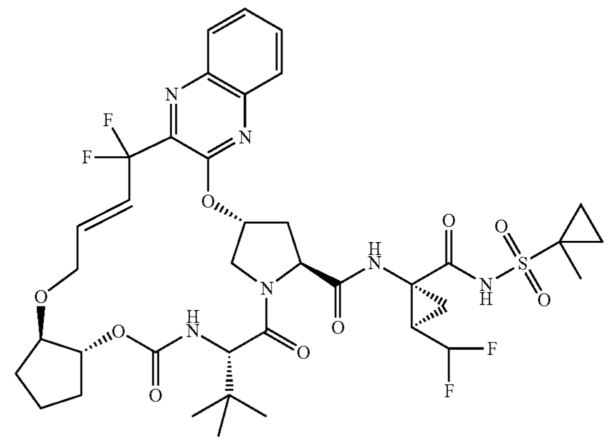 [SMILES: CC(C)(C)[C@@H]1NC(=O)O[C@@H]2CCC[C@H]2OC/C=C/C(F)(F)c2nc3ccccc3nc2O[C@@H]2C[C@@H](C(=O)N[C@]3(C(=O)NS(=O)(=O)C4(C)CC4)C[C@H]3C(F)F)N(C2)C1=O] |
| Voxilaprevir, GS-9857 | 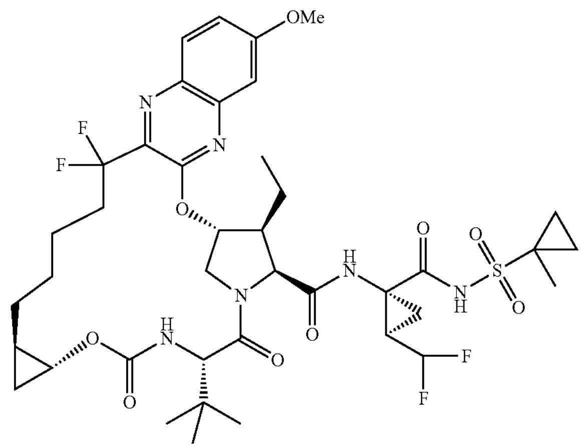 [SMILES: CC[C@@H]1[C@@H]2CN(C(=O)[C@H](C(C)(C)C)NC(=O)O[C@@H]3C[C@H]3CCCCC(F)(F)c3nc4ccc(OC)cc4nc3O2)[C@@H]1C(=O)N[C@]1(C(=O)NS(=O)(=O)C2(C)CC2)C[C@H]1C(F)F] |

In some embodiments of any of the aspects, a repressible protease as described herein is resistant to 1, 2, 3, 4, 5, or more different protease inhibitors as described herein. Non-limiting examples of NS3 amino acid substitutions conferring resistance to HCV NS3 protease inhibitors include: V36L (e.g., genotype 1b), V36M (e.g., genotype 2a), T54S (e.g., genotype 1b), Y56F (e.g., genotype 1b), Q80L (e.g., genotype 1b), Q80R (e.g., genotype 1b), Q80K (e.g., genotype 1a, 1b, 6a), Y132I (e.g., genotype 1b), A156S (e.g., genotype 2a), A156G, A156T, A156V, D168A (e.g., genotype 1b), I170V (e.g., genotype 1b), S20N, R26K, Q28R, A39T, Q41R, I71V, Q80R, Q86R, P89L, P89S, S101N, A111S, P115S, S122R, R155Q, L144F, A150V, R155W, V158L, D168A, D168G, D168H, D168N, D168V, D168E, D168Y, E176K, T178S, M179I, M179V, and M179T. See e.g., Sun et al., Gene Expr. 2018, 18(1): 63-69; Kliemann et al., World J Gastroenterol. 2016 Oct. 28, 22(40): 8910-8917; U.S. Pat. Nos. 7,208,309; 7,494,660; the contents of each of which are incorporated herein by reference in their entireties.

In some embodiments of any of the aspects, a polypeptide as described herein comprises an NS3 protease comprising at least one resistance mutation as described herein or any combination thereof. In some embodiments of any of the aspects, a polypeptide as described herein comprises an NS3 protease that is resistant to one protease inhibitor but responsive to at least one other protease inhibitor. In some embodiments of any of the aspects, a system comprises: (a) a first polypeptide comprising a repressible protease (e.g., NS3) that is resistant to a first protease inhibitor and that is susceptible to a second protease inhibitor; and (b) a second polypeptide comprising a repressible protease (e.g., NS3) that is susceptible to a first protease inhibitor and that is resistant to a second protease inhibitor. Accordingly, presence of the first protease inhibitor can modulate the activity of the second polypeptide but not the first polypeptide, while the presence of the second protease inhibitor can modulate the activity of the first polypeptide but not the second polypeptide.

In some embodiments of any of the aspects, the repressible protease exhibits increased solubility compared to the wild-type protease. As a non-limiting example, the NS3 protease can comprise at least one of the following mutations or any combination thereof: Leu13 is substituted to Glu; Leu14 is substituted to Glu; Ile17 is substituted to Gln; Ile18 is substituted to Glu; and/or Leu21 is substituted to Gln. In some embodiments of any of the aspects, a polypeptide as described herein comprises a repressible protease comprising one of SEQ ID NOs: 154-162, or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 154-162 that maintains the same functions (e.g., serine protease; increased solubility) as SEQ ID NOs: 154-162; see e.g., U.S. Pat. No. 6,333,186 and US Patent Publication US20020106642, the contents of each are incorporated herein by reference in their entireties. In some embodiments of any of the aspects, a polypeptide as described herein comprises a repressible protease comprising one of SEQ ID NOs: 154-162 or a sequence that is at least 95% identical to the sequence of one of SEQ ID NOs: 154-162 that maintains the same functions (e.g., serine protease; increased solubility).

soluble NS3, 182 aa
SEQ ID NO: 154
MAPITAYAQQTRGLLGCIITSLTGRDKNQVEGEVQIVSTAAQTFLATC

INGVCWTVYHGAGTRTIASPKGPVIQMYTNVDKDLVGWPAPQGSRSLT

PCTCGSSDLYLVTRHADVIPVRRRGDSRGSLLSPRPISYLKGSSGGPL

LCPAGHAVGIFRAAVCTRGVAKAVDFIPVESLETTMRS, soluble NS3/NS4A, 195 aa
SEQ ID NO: 155
MKKKGSVVIVGRIVLNGAYAQQTRGLLGCIITSLTGRDKNQVEGEVQI

VSTAAQTFLATCINGVCWTVYHGAGTRTIASPKGPVIQMYTNVDKDLV

GWPAPQGSRSLTPCTCGSSDLYLVTRHADVIPVRRRGDSRGSLLSPRP

ISYLKGSSGGPLLCPAGHAVGIFRAAVCTRGVAKAVDFIPVESLETTM

RSP, soluble NS3/NS4A, 195 aa
SEQ ID NO: 156
MKKKGSVVIVGRIVLNGAYAQQTRGEEGCQETSQTGRDKNQVEGEVQI

VSTAAQTFLATCINGVCWTVYHGAGTRTIASPKGPVIQMYTNVDKDLV

GWPAPQGSRSLTPCTCGSSDLYLVTRHADVIPVRRRGDSRGSLLSPRP

ISYLKGSSGGPLLCPAGHAVGIFRAAVCTRGVAKAVDFIPVESLETTM

RSP, soluble NS3/NS4A, 197 aa
SEQ ID NO: 157
MKKKGSVVIVGRINLSGDTAYAQQTRGEEGCQETSQTGRDKNQVEGEV

QIVSTAAQTFLATCINGVCWTVYHGAGTRTIASPKGPVIQMYTNVDKD

LVGWPAPQGSRSLTPCTCGSSDLYLVTRHADVIPVRRRGDSRGSLLSP

RPISYLKGSSGGPLLCPAGHAVGIFRAAVCTRGVAKAVDFIPVESLET

TMRSP, soluble NS3/NS4A, 197 aa
SEQ ID NO: 158
MKKKGSVVIVGRINLSGDTAYAQQTRGEEGCQETSQTGRDKNQVEGEV

QIVSTATQTFLATCINGVCWTVYHGAGTRTIASPKGPVTQMYTNVDKD

LVGWQAPQGSRSLTPCTCGSSDLYLVTRHADVIPVRRRGDSRGSLLSP

RPISYLKGSSGGPLLCPAGHAVGIFRAAVSTRGVAKAVDFIPVESLET

TMRSP, soluble NS3/NS4A, 197 aa
SEQ ID NO: 159
MKKKGSVVIVGRINLSGDTAYAQQTRGEEGCQETSQTGRDKNQVEGEV

QIVSTATQTFLATSINGVLWTVYHGAGTRTIASPKGPVTQMYTNVDKD

LVGWQAPQGSRSLTPCTCGSSDLYLVTRHADVIPVRRRGDSRGSLLSP

RPISYLKGSSGGPLLCPAGHAVGIFRAAVSTRGVAKAVDFIPVESLET

TMRSP, soluble NS3/NS4A, 197 aa
SEQ ID NO: 160
MKKKGSVVIVGRINLSGDTAYAQQTRGEQGCQKTSHTGRDKNQVEGEV

QIVSTATQTFLATSINGVLWTVYHGAGTRTIASPKGPVTQMYTNVDKD

LVGWQAPQGSRSLTPCTCGSSDLYLVTRHADVIPVRRRGDSRGSLLSP

RPISYLKGSSGGPLLCPAGHAVGIFRAAVSTRGVAKAVDFIPVESLET

TMRSP, soluble NS3/NS4A, 197 aa
SEQ ID NO: 161
MKKKGSVVIVGRINLSGDTAYAQQTRGEQGTQKTSHTGRDKNQVEGEV

QIVSTATQTFLATSINGVLWTVYHGAGTRTIASPKGPVTQMYTNVDKD

LVGWQAPQGSRSLTPCTCGSSDLYLVTRHADVIPVRRRGDSRGSLLSP

RPISYLKGSSGGPLLCPAGHAVGIFRAAVSTRGVAKAVDFIPVESLET

TMRSP,

NS3aH1, soluble NS3/NS4A (S139A), 196 aa
SEQ ID NO: 162
KKKGSVVIVGRINLSGDTAYAQQTRGEEGCQETSQTGRDKNQVEGEVQ

IVSTATQTFLATSINGVLWTVYHGAGTRTIASPKGPVTQMYTNVDKDL

VGWQAPQGSRSLTPCTCGSSDLYLVTRHADVIPVRRRGDSRGSLLSPR

PISYLKGSAGGPLLCPAGHAVGIFRAAVSTRGVAKAVDFIPVESLETT

MRSP,

In some embodiments of any of the aspects, the repressible protease comprises mutations to increase binding affinity for a specific ligand. As a non-limiting example, NS3aH1 (e.g., SEQ ID NO: 162) comprises four mutations needed for interaction with the ANR peptide (e.g., SEQ ID NO: 170): A7S, E13L, I35V and T42S. Accordingly, in some embodiments of any of the aspects, a repressible protease as described herein comprises at least one of the following mutations: A7S, E13L, I35V and T42S, or any combination thereof.

In several aspects, described herein are polypeptides comprising a reader domain (As used herein, the term "reader domain" refers to a polypeptide sequence that specifically binds to a repressible protease as described herein in the presence of a specific protease inhibitor. As a non-limiting example, a reader polypeptide as described herein can comprise a reader domain. In some embodiments of any of the aspects, a polypeptide as described herein (or a polypeptide system collectively) comprises 1, 2, 3, 4, 5, or more reader domains. In some embodiments of any of the aspects, the polypeptide or system comprises one reader domain. In embodiments comprising multiple reader domains, the multiple reader domains can be different individual reader domains or multiple copies of the same reader domain, or a combination of the foregoing.

In some embodiments of any of the aspects, a polypeptide as described herein comprises a reader domain that recognizes a specific inhibitor-bound state of the HCV NS3 repressible protease. As a non-limiting example, the reader domain can specifically bind to at least one of the following protease inhibitors: grazoprevir, danoprevir, simeprevir, asunaprevir, ciluprevir, boceprevir, sovaprevir, paritaprevir, ombitasvir, paritaprevir, ritonavir, dasabuvir, telaprevir, or a protease inhibitor selected from Table 14. In some embodiments of any of the aspects, the reader domain comprises the scaffold of leucine-rich repeat proteins (LRRs), designed helical repeat proteins (DHRs), ferredoxins and/or helical bundles, that has been designed to specifically bind to a specific protease inhibitor in combination with a repressible protease; see e.g., Foight et al., Nat Biotechnol. 2019 October; 37(10):1209-1216, the content of which is incorporated herein by reference in its entirety. In some embodiments of any of the aspects, the polypeptide is bound to a protease inhibitor bound to the reader domain. In some embodiments of any of the aspects, the polypeptide is bound specifically to a protease inhibitor bound to the reader domain.

In some embodiments of any of the aspects, the polypeptide comprising a reader domain is in combination with 1, 2, 3, 4, 5, or more protease inhibitors. In some embodiments of any of the aspects, the polypeptide comprising a reader domain is in combination with one protease inhibitor. In embodiments comprising multiple protease inhibitors, the multiple protease inhibitors can be different individual protease inhibitors or multiple copies of the same protease inhibitor, or a combination of the foregoing.

In some embodiments of any of the aspects, the reader domain comprises a danoprevir/NS3 complex reader (DNCR). Non-limiting examples of DNCRs include D3, DNCR1, and DNCR2. In some embodiments of any of the aspects, the reader domain comprises DNCR2 (e.g., SEQ ID NO: 163), which has an affinity for the NS3a/danoprevir complex of 36 pM, and no detectable binding to apo NS3a and >20,000-fold selectivity over NS3a bound to the drugs grazoprevir or asunaprevir. DNCR2 does not bind substantially to free danoprevir. DNCR2/danoprevir/NS3a forms a 1:1:1 complex.

In some embodiments of any of the aspects, the reader domain comprises a grazoprevir/NS3 complex reader (GNCR). Non-limiting examples of GNCRs include GNCR1 and G3. In some embodiments of any of the aspects, the reader domain comprises GNCR1 (e.g., SEQ ID NOs: 164 or 165), which demonstrates an affinity for the grazoprevir/NS3a complex of 140 nM and little to no affinity for apo, danoprevir-bound or asunaprevir-bound NS3a.

In some embodiments of any of the aspects, the reader domain comprises D5 (e.g., SEQ ID NO: 166), which demonstrates moderate binding of NS3 in the presence of danoprevir or grazoprevir and some binding of NS3 in the presence of asunaprevir. In some embodiments of any of the aspects, the reader domain comprises DNCR1 (e.g., SEQ ID NO: 167), which demonstrates high binding of NS3 in the presence of danoprevir and minimal binding of NS3 in the presence of asunaprevir or grazoprevir. In some embodiments of any of the aspects, the reader domain comprises G3 (e.g., SEQ ID NO: 168), which demonstrates moderate binding of NS3 in the presence of grazoprevir, some binding of NS3 in the presence of asunaprevir, and no binding to NS3 in the presence of danoprevir. In some embodiments of any of the aspects, the reader domain comprises a asunaprevir/NS3 complex reader, including but not limited to D5 and G3.

In some embodiments of any of the aspects, the reader domain of a polypeptide as described herein comprises one of SEQ ID NOs: 163-168, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 163-168 that maintains the same functions as one of SEQ ID NOs: 163-168 (e.g., binding to a repressible protease in the presence of a specific protease inhibitor). In some embodiments of any of the aspects, the reader domain of a polypeptide as described herein comprises one of SEQ ID NOs: 163-168, or an amino acid sequence that is at least 95% identical to the sequence of one of SEQ ID NOs: 163-168 that maintains the same functions as one of SEQ ID NOs: 163-168.

```
DNCR2, 229 aa
                                    SEQ ID NO: 163
SSDEEEARELIERAKEAAERAQEAAERTGDPRVRELARELKRLAQEAA

EEVKRDPSSSDVNEALKLIVEAIEAAVDALEAAERTGDPEVRELAREL

VRLAVEAAEEVQRNPSSSDVNEALHSIVYAIEAAIFALEAAERTGDPE

VRELARELVRLAVEAAEEVQRNPSSRNVEHALMRIVLAIYLAEENLRE

AEESGDPEKREKARERVREAVERAEEVQRDPSGWLNH,

GNCR1, 195 aa (corresponds to amino acids 39 to
233 of SEQ ID NO: 165):
                                    SEQ ID NO: 164
LANLAVAAVLTACLLAQEHPNADIAKLCIKAASEAAEAASKAAELAQR

HPDSQAARDAIKLASQAARAVILAIMLAAENPNADIAKLCIKAASEAA

EAASKAAELAQRHPDSQAARDAIKLASQAAEAVERAIWLAAENPNADI

AKKCIKAASEAAEEASKAAEEAQRHPDSQKARDEIKEASQKAEEVKER

CKS

GNCR1, 233 aa:
                                    SEQ ID NO: 165
DIEKLCKKAEEEAKEAQEKADELRQRHPDSQAAEDAEDLANLAVAAVL

TACLLAQEHPNADIAKLCIKAASEAAEAASKAAELAQRHPDSQAARDA

IKLASQAARAVILAIMLAAENPNADIAKLCIKAASEAAEAASKAAELA

QRHPDSQAARDAIKLASQAAEAVERAIWLAAENPNADIAKKCIKAASE

AAEEASKAAEEAQRHPDSQKARDEIKEASQKAEEVKERCKS,

D5, 229 aa
                                    SEQ ID NO: 166
SSDEEEARELIERAKEAAERAQEAAERTGDPRVRELARELKRLAQEAA

EEVKRDPSSSDVNEALKLIVEAIEAAVDALEAAERTGDPEVRELAREL

VRLAVEAAEEVQRNPSSSDVNEALLTIVIAIEAAVNALEAAERTGDPE

VRELARELVRLAVEAAEEVQRNPSSREVNIALWKIVLAIQEAVESLRE

AEESGDPEKREKARERVREAVERAEEVQRDPSGWLNH,

DNCR1, 229 aa
                                    SEQ ID NO: 167
SSDEEEARELIERAKEAAERAQEAAERTGDPRVRELARELKRLAQEAA

EEVKRDPSSSDVNEALKLIVEAIEAAVDALEAAERTGDPEVRELAREL

VRLAVEAAEEVQRNPSSSDVNEALLSIVIAIEAAVHALEAAERTGDPE

VRELARELVRLAVEAAEEVQRNPSSREVEHALMKIVLAIYEAEESLRE

AEESGDPEKREKARERVREAVERAEEVQRDPSGWLNH,
```

-continued

G3, 233 aa

SEQ ID NO: 168
DIEKLCKKAEEEAKEAQEKADELRQRHPDSQAAEDAEDLANEAEAAVL

AACSLAQEHPNADIAKLCIKAASEAAEAASKAAELAQRHPDSQAARDA

IKLASQAARAVILAIMLAAENPNADIAKLCIKAASEAAEAASKAAELA

QRHPDSQAARDAIKLASQAAEAVERAIWLAAENPNADIAKKCIKAASE

AAEEASKAAEEAQRHPDSQKARDEIKEASQKAEEVKERCKS,

In some embodiments of any of the aspects, a reader domain is specific for a certain genotype of repressible protease. As a non-limiting example, the reader domain (e.g., DNCR or GNCR; e.g., SEQ ID NO: 163-168) interacts with genotype 1a NS3a (e.g., SEQ ID NO: 89-90, 98, 104). In some embodiments of any of the aspects, the repressible protease that specifically binds to the reader domain is catalytically active. In some embodiments of any of the aspects, the repressible protease that specifically binds to the reader domain is catalytically inactive. Accordingly, described herein are systems comprising a reader domain (e.g., SEQ ID NOs: 163-168) and a repressible protease (e.g., SEQ ID NO: 89-90, 98 (catalytically active), SEQ ID NO: 104 (catalytically inactive)). In some embodiments of any of the aspects, the polypeptide comprising the repressible protease further comprises a cofactor, e.g., NS4A, which can be the same or different genotype as the NS3A. In some embodiments of any of the aspects, the inducible dimerization system further comprises genotype 1a NS4A (e.g., SEQ ID NO: 105).

In some embodiments of any of the aspects, a polypeptide as described herein comprises a linker domain adjacent (e.g., N-terminal and/or C-terminal) to the reader domain. In some embodiments of any of the aspects, the reader domain linker comprises SEQ ID NO: 169 (SSGGSGSGSSGGSGT) or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 169.

In several aspects, described herein are polypeptides comprising a peptide domain. As used herein, the term "peptide domain" refers to a short polypeptide domain that can specifically bind to a repressible protease as described herein (e.g., NS3 protease). The peptide domain can also be referred to herein as a "protease-binding domain". In some embodiments of any of the aspects, any peptide that can bind to the repressible protease can be used. In some embodiments of any of the aspects, the peptide domain comprises a protease cleavage site as described herein (e.g., SEQ ID NOs: 131-152) and is a substrate peptidomimetic. In some embodiments of any of the aspects, the peptide domain is specifically bound by but not cleaved by the repressible protease. As a non-limiting example, an OFF-switch polypeptide as described herein can comprise a peptide domain. In some embodiments of any of the aspects, a polypeptide as described herein (or a polypeptide system collectively) comprises 1, 2, 3, 4, 5, or more peptide domains. In some embodiments of any of the aspects, the polypeptide or system comprises one peptide domain. In embodiments comprising multiple peptide domains, the multiple peptide domains can be different individual peptide domains or multiple copies of the same peptide domain, or a combination of the foregoing.

Table 15 lists non-limiting examples of peptide domains (e.g., for NS3 protease). Such inhibitory peptides cap the active site and bind via a "tyrosine" finger at an alternative NS3-4A site. The peptides are not cleaved due to a combination of geometrical constraints and impairment of the oxyanion hole function. Negligible susceptibility to known (e.g., A156V and R155K) resistance mutations of the NS3-4A protease have been observed. Accordingly, non-limiting examples of peptide domains include: CP5-46-5D5E, K5-66, K5-66-A, K5-66-B, K6-10, K6-10A, K6-10B K5-66-R, CP5-46, CP5-46-4D5E, CP5-46-A, CP5-46A-4D5E, Ant-CP5-46A-4D5E, and apo NS3a reader (ANR) peptides (see e.g., Kugler et al., High Affinity Peptide Inhibitors of the Hepatitis C Virus NS3-4A Protease Refractory to Common Resistant Mutants, J Biol Chem. 2012 Nov. 9; 287(46): 39224-39232; Cunningham-Bryant et al., J Am Chem Soc. 2019 Feb. 27; 141(8):3352-3355).

TABLE 15

Exemplary Peptide Domains

| SEQ ID NO: | Peptide | Sequence |
|---|---|---|
| 170 | ANR | GELDELVYLLDGPGYDPIHSD |
| 171 | CP5-46-5D5E | GELDELVYLLDGPGYDPIHCD VVTRGGSHLFNF |
| 172 | K5-66 | GELGRLVYLLDGPGYDPIHC SLAYGDASTLVVF |
| 173 | K5-66-A | GELGRLVYLLDGPGYDPI |
| 174 | K5-66-B | HCSLAYGDASTLVVF |
| 175 | K6-10 | GELGRPVYVLGDPGYYATHCI YATTNDALIFSV |
| 176 | K6-10-A | GELGRPVYVLGDPGYYAT |
| 177 | K6-10-B | HCIYATTNDALIFSV |
| 178 | K5-66-R | GELGRIPSDTYDLAVGALHCP FYLVSGLVYLDG |
| 179 | CP5-46 | GELGRLVYLLDGPGYDPIHCD VVTRGGSHLFNF |
| 180 | CP5-46-4D5E | GELDELVYLLDGPGYDPIHCD VVTRGGSHLFNF |
| 181 | CP5-46-A | GELGRLVYLLDGPGYDPIHCD |
| 182 | CP5-46A-4D5E | GELDELVYLLDGPGYDPIHS |
| 183 | Ant-CP5-46A-4D5E | RQIK IWFQNRRMKWKKGELD ELVYLLDGPGYDPIHS |

In some embodiments of any of the aspects, the peptide domain of a polypeptide as described herein comprises one of SEQ ID NOs: 170-183 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 170-183, that maintains the same functions as one of SEQ ID NOs: 170-183 (e.g., binding to a repressible protease). In some embodiments of any of the aspects, the peptide domain of a polypeptide as described herein comprises one of SEQ ID NOs: 170-183, or an amino acid sequence that is at least 95% identical to the sequence of one of SEQ ID NOs: 170-183, that maintains the same functions as one of SEQ ID NOs: 170-183.

In some embodiments of any of the aspects, the peptide domain is ANR (SEQ ID NO: 170). In some embodiments of any of the aspects, the peptide domain is CP5-46-5D5E (SEQ ID NO: 171). In some embodiments of any of the aspects, a peptide domain is specific for a certain genotype of repressible protease. As a non-limiting example, the peptide (e.g., ANR, CP5-46-5D5E, or another associated peptide; SEQ ID NO: 170-183) interacts with genotype 1b NS3a (e.g., SEQ ID NO: 91, 99, 103) or an NS3 comprising the following mutations: A7S, E13L, I35V and T42S (e.g., SEQ ID NO: 162). Apo NS3a reader (ANR) forms a basal complex with NS3a-genotype 1b with an affinity of 10 nM, which is disrupted by NS3a-targeting drugs. In some embodiments of any of the aspects, the repressible protease that specifically binds to the peptide domain is catalytically active. In some embodiments of any of the aspects, the repressible protease that specifically binds to the peptide domain is catalytically inactive. Accordingly, described herein are systems comprising a peptide domain (e.g., SEQ ID NOs: 170-183) and a repressible protease (e.g., SEQ ID NO: 91, 99 (catalytically active), SEQ ID NO: 104 (catalytically inactive)). In some embodiments of any of the aspects, the polypeptide comprising the repressible protease further comprises a cofactor, e.g., NS4A, which can be the same or different genotype as the NS3A. In some embodiments of any of the aspects, the repressible dimerization system further comprises genotype 1b NS4A (e.g., SEQ ID NO: 108).

In several aspects, described herein are polypeptides comprising a cytosolic sequestering domain or protein, also referred to herein as a translocation domain or sequestering domain. As used herein, the term "cytosolic sequestering domain" refers to a domain that influences the subcellular location of the polypeptide to which it is linked, e.g., through the binding of a ligand.

In some embodiments of any of the aspects, a polypeptide as described herein (or a polypeptide system collectively) comprises 1, 2, 3, 4, 5, or more cytosolic sequestering domain(s). In some embodiments of any of the aspects, the polypeptide or system comprises one cytosolic sequestering domain. In some embodiments of any of the aspects, the polypeptide or system comprises two cytosolic sequestering domains. In embodiments comprising multiple cytosolic sequestering domains, the multiple cytosolic sequestering domains can be different individual cytosolic sequestering domains or multiple copies of the same cytosolic sequestering domain, or a combination of the foregoing.

In some embodiments of any of the aspects, the cytosolic sequestering protein comprises a ligand binding domain (LBD), wherein in the presence of the ligand, the sequestering of the protein to the cytosol is inhibited. In some embodiments of any of the aspects, cytosolic sequestering protein further comprises a nuclear localization signal (NLS), wherein in the absence of the ligand the NLS is inhibited thereby preventing translocation of the sequestering protein to the nucleus, and wherein in the presence of the ligand the nuclear localization signal is exposed enabling translocation of the sequestering protein to the nucleus. Accordingly, when the ligand is absent, the polypeptide is sequestered to the cytosol. When the ligand is absent, the polypeptide is translocated to the nucleus.

In some embodiments of any of the aspects, the sequestering protein comprises at least a portion of the estrogen receptor (ER). The ER naturally associates with cytoplasmic factors in the cell in the absence of cognate ligands, effectively sequestering itself in the cytoplasm. Binding of cognate ligands, such as estrogen or other steroid hormone derivatives, cause a conformational change to the receptor that allow dissociation from the cytoplasmic complexes and expose a nuclear localization signal, permitting translocation into the nucleus.

In some embodiments of any of the aspects, the sequestering protein comprises SEQ ID NO: 184 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 184 that maintains the same function. In some embodiments of any of the aspects, the sequestering protein comprises a portion of the ER (e.g., SEQ ID NO: 184), e.g., the C-terminal ligand-binding and nuclear localization domains of ER. In some embodiments of any of the aspects, the sequestering protein comprises residues 282-595 of SEQ ID NO: 184 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to residues 282-595 of SEQ ID NO: 184.

estrogen receptor (ER) isoform 1 [*Homo sapiens*];
NCBI Reference Sequence: NP_000116.2 (595 aa)
SEQ ID NO: 184

MTMTLHTKASGMALLHQIQGNELEPLNRPQLKIPLERPLGEVYLDSSK

PAVYNYPEGAAYEFNAAAAANAQVYGQTGLPYGPGSEAAAFGSNGLGG

FPPLNSVSPSPLMLLHPPPQLSPFLQPHGQQVPYYLENEPSGYTVREA

GPPAFYRPNSDNRRQGGRERLASTNDKGSMAMESAKETRYCAVCNDYA

SGYHYGVWSCEGCKAFFKRSIQGHNDYMCPATNQCTIDKNRRKSCQAC

RLRKCYEVGMMKGGIRKDRRGGRMLKHKRQRDDGEGRGEVGSAGDMRA

ANLWPSPLMIKRSKKNSLALSLTADQMVSALLDAEPPILYSEYDPTRP

FSEASMMGLLTNLADRELVHMINWAKRVPGFVDLTLHDQVHLLECAWL

EILMIGLVWRSMEHPGKLLFAPNLLLDRNQGKCVEGMVEIFDMLLATS

SRFRMMNLQGEEFVCLKSIILLNSGVYTFLSSTLKSLEEKDHIHRVLD

KITDTLIHLMAKAGLTLQQQHQRLAQLLLILSHIRHMSNKGMEHLYSM

KCKNVVPLYDLLLEMLDAHRLHAPTSRGGASVEETDQSHLATAGSTSS

HSLQKYYITGEAEGFPATV,

In some embodiments of any of the aspects, the estrogen receptor comprises at least one mutation that decreases its ability to bind to its natural ligands (e.g., estradiol) but maintains the ability to bind to synthetic ligands such as tamoxifen and analogs thereof. In some embodiments of any of the aspects, the estrogen receptor comprises at least one of the following mutations: G400V, G521R, L539A, L540A, M543A, L544A, V595A or any combination thereof. In some embodiments of any of the aspects, a triple G400V/MS43A/L544A ER mutant is referred to herein as ERT2. In some embodiments of any of the aspects, the sequestering protein further comprises a V595A mutation from ER (e.g., SEQ ID NO: 184). In some embodiments of any of the aspects, the sequestering protein comprises an estrogen ligand binding domain (ERT2) or a variant thereof.

In some embodiments of any of the aspects, the sequestering protein comprises ERT, ERT2, ERT3, or a variant thereof. In some embodiments of any of the aspects, the sequestering protein comprises one of SEQ ID NOs: 185-189 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 185-189, that maintains the same function. See e.g., U.S. Pat. No. 7,112,715; Feil et al., Biochemical and Biophysical Research Communications, Volume 237, Issue 3, 28 Aug. 1997, Pages 752-757; Felker et al., PLoS One. 2016 Apr. 14; 11(4):e0152989; the contents of each of which are incorporated herein by reference in their enteritis.

ERT2 (314 aa), G400V, M543A, L544A, and V595A
mutations from ER (e.g., SEQ ID NO: 184) shown
in bold, double underlined text
                                     SEQ ID NO: 185
SAGDMRAANLWPSPLMIKRSKKNSLALSLTADQMVSALLDAEPPILYS

EYDPTRPFSEASMMGLLTNLADRELVHMINWAKRVPGFVDLTLHDQVH

LLECAWLEILMIGLVWRSMEHPVKLLFAPNLLLDRNQGKCVEGMVEIF

DMLLATSSRFRMMNLQGEEFVCLKSIILLNSGVYTFLSSTLKSLEEKD

HIHRVLDKITDTLIHLMAKAGLTLQQQHQRLAQLLLILSHIRHMSNKG

MEHLYSMKCKNVVPLYDLLLEAADAHRLHAPTSRGGASVEETDQSHLA

TAGSTSSHSLQKYYITGEAEGFPATA,

ERT2 (313 aa; corresponds to aa 2-314 of SEQ
ID NO: 185), G400V, M543A, L544A, and V595A
mutations from ER (e.g., SEQ ID NO: 184) shown
in bold, double underlined text
                                     SEQ ID NO: 186
AGDMRAANLWPSPLMIKRSKKNSLALSLTADQMVSALLDAEPPILYSE

YDPTRPFSEASMMGLLTNLADRELVHMINWAKRVPGFVDLTLHDQVHL

LECAWLEILMIGLVWRSMEHPVKLLFAPNLLLDRNQGKCVEGMVEIFD

MLLATSSRFRMMNLQGEEFVCLKSIILLNSGVYTFLSSTLKSLEEKDH

IHRVLDKITDTLIHLMAKAGLTLQQQHQRLAQLLLILSHIRHMSNKGM

EHLYSMKCKNVVPLYDLLLEAADAHRLHAPTSRGGASVEETDQSHLAT

AGSTSSHSLQKYYITGEAEGFPATA,

ERT (314 aa), G521R mutation from ER (e.g.,
SEQ ID NO: 184) shown in bold, double
underlined text
                                     SEQ ID NO: 187
SAGDMRAANLWPSPLMIKRSKKNSLALSLTADQMVSALLDAEPPILYS

EYDPTRPFSEASMMGLLTNLADRELVHMINWAKRVPGFVDLTLHDQVH

LLECAWLEILMIGLVWRSMEHPGKLLFAPNLLLDRNQGKCVEGMVEIF

DMLLATSSRFRMMNLQGEEFVCLKSIILLNSGVYTFLSSTLKSLEEKD

HIHRVLDKITDTLIHLMAKAGLTLQQQHQRLAQLLLILSHIRHMSNKR

MEHLYSMKCKNVVPLYDLLLEMLDAHRLHAPTSRGGASVEETDQSHLA

TAGSTSSHSLQKYYITGEAEGFPATV,

ERT3 (314 aa), M543A, L544A, and V595A mutations
from ER (e.g., SEQ ID NO: 184) shown in bold,
double underlined text
                                     SEQ ID NO: 188
SAGDMRAANLWPSPLMIKRSKKNSLALSLTADQMVSALLDAEPPILYS

EYDPTRPFSEASMMGLLTNLADRELVHMINWAKRVPGFVDLTLHDQVH

LLECAWLEILMIGLVWRSMEHPGKLLFAPNLLLDRNQGKCVEGMVEIF

DMLLATSSRFRMMNLQGEEFVCLKSIILLNSGVYTFLSSTLKSLEEKD

HIHRVLDKITDTLIHLMAKAGLTLQQQHQRLAQLLLILSHIRHMSNKG

MEHLYSMKCKNVVPLYDLLLEAADAHRLHAPTSRGGASVEETDQSHLA

TAGSTSSHSLQKYYITGEAEGFPATA,

ERT (314 aa), G400V, L539A, L540A mutations from
ER (e.g., SEQ ID NO: 184) shown in bold, double
underlined text
                                     SEQ ID NO: 189
SAGDMRAANLWPSPLMIKRSKKNSLALSLTADQMVSALLDAEPPILYS

EYDPTRPFSEASMMGLLTNLADRELVHMINWAKRVPGFVDLTLHDQVH

LLECAWLEILMIGLVWRSMEHPVKLLFAPNLLLDRNQGKCVEGMVEIF

DMLLATSSRFRMMNLQGEEFVCLKSIILLNSGVYTFLSSTLKSLEEKD

HIHRVLDKITDTLIHLMAKAGLTLQQQHQRLAQLLLILSHIRHMSNKG

MEHLYSMKCKNVVPLYDAALEMLDAHRLHAPTSRGGASVEETDQSHLA

TAGSTSSHSLQKYYITGEAEGFPATV,

In some embodiments of any of the aspects, the sequestering protein of the polypeptide is in combination with 1, 2, 3, 4, 5, or more ligands. In some embodiments of any of the aspects, the sequestering protein of the polypeptide is in combination with one ligand. In embodiments comprising multiple ligands, the multiple ligands can be different individual ligands or multiple copies of the same ligands, or a combination of the foregoing.

In some embodiments of any of the aspects, the ligand is estradiol (PubChem CID: 5757), or an analog thereof. In some embodiments of any of the aspects, the ligand is a synthetic ligand of the estrogen receptor, such as tamoxifen or a derivative thereof. In some embodiments of any of the aspects, the ligand is selected from: tamoxifen, 4-hydroxytamoxifen (4OHT), endoxifen, and Fulvestrant, wherein binding of the ligand to the ERT (e.g., ERT2) exposes the NLS and results in nuclear translocation of the ERT. In some embodiments of any of the aspects, the ligand is 4-hydroxytamoxifen (4-OHT), shown below (PubChem CID: 449459), which can also be referred to as afimoxifene. In some embodiments of any of the aspects, the ligand is 4-Hydroxy-N-desmethyltamoxifen, shown below (PubChem CID: 10090750), which can also be referred to as endoxifen. In some embodiments of any of the aspects, the ligand is Fulvestrant shown below (PubChem CID 104741), which can also be referred to as ICI 182, 780.

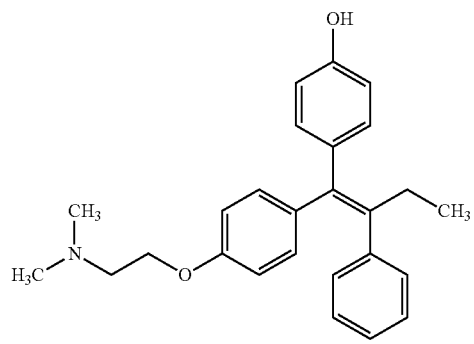
trans-4-OHT

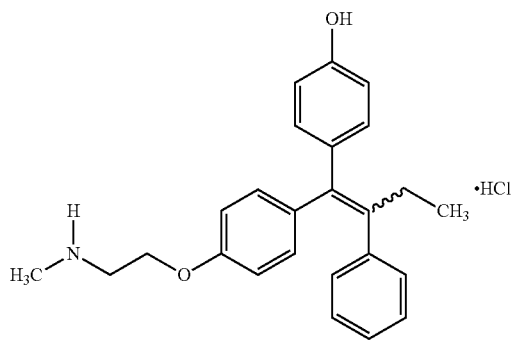
Endoxifen

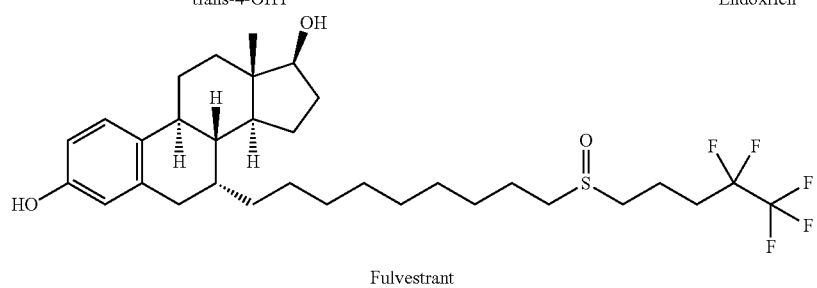
Fulvestrant

In some embodiments of any of the aspects, the sequestering domain of the polypeptide is a transmembrane sequestering domain, and the polypeptide fragment of the nuclease or recombinase is linked to the cytosolic side of the transmembrane sequestering domain. In the absence of a specific ligand for the transmembrane domain, the transmembrane protein is sequestered to the cellular membrane. In the presence of a specific ligand for the transmembrane domain, the transmembrane protein cleaves itself such that the polypeptide fragment of the nuclease or recombinase is released into the cytosol to be transported to the nucleus. Non-limiting examples of transmembrane sequestering domains include a synthetic notch receptor or first and second exogenous extracellular sensors, described further herein.

In some embodiments of any of the aspects, the transmembrane sequestering protein comprises a Notch receptor or a variant of endogenous Notch receptor, such as a synthetic Notch (synNotch) receptor. In some embodiments of any the aspects, the polypeptide comprising a synNotch comprises: (a) an extracellular domain comprising a first member of a specific binding pair that is heterologous to the Notch receptor; (b) a Notch receptor regulatory region; and (c) an intracellular domain comprising the polypeptide fragment of the nuclease or recombinase. In the presence of a second member of the specific binding pair, binding of the first member of the specific binding pair to the second member of the specific binding pair induces cleavage of the binding-induced proteolytic cleavage site to activate the intracellular domain, thereby permitting the polypeptide fragment of the nuclease or recombinase to translocate to the nucleus. In the absence of a second member of the specific binding pair, the polypeptide fragment of the nuclease or recombinase remains sequestered at the cellular membrane.

In some embodiments of any of the aspects, the transmembrane sequestering protein comprises one of SEQ ID NOs: 190-191 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 190-191, that maintains the same function. See e.g., U.S. Pat. No. 10,590,182; Morsut et al., Cell. 2016 Feb. 11; 164(4):780-91; the contents of which are incorporated herein by reference in their entireties.

In some embodiments of any of the aspects, the Notch receptor regulatory region comprises Lin-12 Notch repeats A-C, heterodimerization domains HD-N and HD-C, a binding-induced proteolytic cleavage site, and a transmembrane domain. In some embodiments of any the aspects, the Notch variant is a Notch receptor where the Notch extracellular subunit (NEC) (which includes the negative regulatory region (NRR)) is partially or completely removed. In some embodiments of any of the aspects, the Notch receptor regulatory region is a truncated or modified variant of synNotch, e.g., lacking one or more of the following domains: Lin-12 Notch repeats A-C, heterodimerization domains HD-N and HD-C, a binding-induced proteolytic cleavage site, the Notch extracellular domain (NEC), the negative regulatory region (NRR), or a transmembrane domain.

synNotch (306 aa)
SEQ ID NO: 190
PPQIEEACELPECQVDAGNKVCNLQCNNHACGWDGGDCSLNFNDPWKN

CTQSLQCWKYFSDGHCDSQCNSAGCLFDGFDCQLTEGQCNPLYDQYCK

DHFSDGHCDQGCNSAECEWDGLDCAEHVPERLAAGTLVLVVLLPPDQL

RNNSFHFLRELSHVLHTNVVFKRDAQGQQMIFPYYGHEEELRKHPIKR

STVGWATSSLLPGTSGGRQRRELDPMDIRGSIVYLEIDNRQCVQSSSQ

CFQSATDVAAFLGALASLGSLNIPYKIEAVKSEPVEPPLPSQLHLMYV

AAAAFVLLFFVGCGVLLS,

-continued synNotch (358 aa)

SEQ ID NO: 191

PCVGSNPCYNQGTCEPTSENPFYRCLCPAKFNGLLCHILDYSFTGGAG

RDIPPPQIEEACELPECQVDAGNKVCNLQCNNHACGWDGGDCSLNFND

PWKNCTQSLQCWKYFSDGHCDSQCNSAGCLFDGFDCQLTEGQCNPLYD

QYCKDHFSDGHCDQGCNSAECEWDGLDCAEHVPERLAAGTLVLVVLLP

PDQLRNNSFHFLRELSHVLHTNVVFKRDAQGQQMIFPYYGHEEELRKH

PIKRSTVGWATSSLLPGTSGGRQRRELDPMDIRGSIVYLEIDNRQCVQ

SSSQCFQSATDVAAFLGALASLGSLNIPYKIEAVKSEPVEPPLPSQLH

LMYVAAAAFVLLFFVGCGVLLS,

Suitable first members of a specific binding pairs (e.g., of the synNotch) include, but are not limited to, antibody-based recognition scaffolds; antibodies (i.e., an antibody-based recognition scaffold, including antigen-binding antibody fragments); non-antibody-based recognition scaffolds; antigens (e.g., endogenous antigens; exogenous antigens; etc.); a ligand for a receptor; a receptor; a target of a non-antibody-based recognition scaffold; an Fc receptor (e.g., FcγRIIIa; FcγRIIIb; etc.); an extracellular matrix component; and the like.

Specific binding pairs (e.g., of the synNotch) include, e.g., antigen-antibody specific binding pairs, where the first member is an antibody (or antibody-based recognition scaffold) that binds specifically to the second member, which is an antigen, or where the first member is an antigen and the second member is an antibody (or antibody-based recognition scaffold) that binds specifically to the antigen; ligand-receptor specific binding pairs, where the first member is a ligand and the second member is a receptor to which the ligand binds, or where the first member is a receptor, and the second member is a ligand that binds to the receptor; non-antibody-based recognition scaffold-target specific binding pairs, where the first member is a non-antibody-based recognition scaffold and the second member is a target that binds to the non-antibody-based recognition scaffold, or where the first member is a target and the second member is a non-antibody-based recognition scaffold that binds to the target; adhesion molecule-extracellular matrix binding pairs; Fc receptor-Fc binding pairs, where the first member comprises an immunoglobulin Fc that binds to the second member, which is an Fc receptor, or where the first member is an Fc receptor that binds to the second member which comprises an immunoglobulin Fc; and receptor-co-receptor binding pairs, where the first member is a receptor that binds specifically to the second member which is a co-receptor, or where the first member is a co-receptor that binds specifically to the second member which is a receptor.

In some embodiments of any the aspects, the transmembrane sequestering domain comprises first and second exogenous extracellular sensors, wherein said first exogenous extracellular sensor comprises: (a) a ligand binding domain, (b) a transmembrane domain, (c) a protease cleavage site, and (d) the polypeptide fragment of the nuclease or recombinase; and wherein said second exogenous extracellular sensor comprises: (e) a ligand binding domain, (f) a transmembrane domain, and (g) a protease domain. Such a system can also be referred to as a modular extracellular sensor architecture (MESA) system. In the presence of a ligand for the first and second exogenous extracellular sensors, the two receptors are brought into proximity, permitting the protease to cleave the protease cleavage site and release the polypeptide fragment of the nuclease or recombinase into the cytosol to be translocated to the nucleus. In the absence of a ligand for the first and second exogenous extracellular sensors, the polypeptide fragment of the nuclease or recombinase remains sequestered at the cell membrane. In some embodiments of any of the aspects, the protease comprises any protease as described herein (e.g., NS3), and the protease cleavage site comprises an NS3 protease cleavage site as described herein. See e.g., US Patent Application 2014/0234851; Daringer et al., ACS Synth. Biol. 2014, 3, 12, 892-902.

Any type of suitable ligand binding domain (LB) can be employed with transmembrane receptor sequestering protein. Ligand binding domains can, for example, be derived from either an existing receptor ligand-binding domain or from an engineered ligand binding domain. Existing ligand-binding domains could come, for example, from cytokine receptors, chemokine receptors, innate immune receptors (TLRs, etc.), olfactory receptors, steroid and hormone receptors, growth factor receptors, mutant receptors that occur in cancer, neurotransmitter receptors. Engineered ligand-binding domains can be, for example, single-chain antibodies (see scFv constructs discussion below), engineered fibronectin based binding proteins, and engineered consensus-derived binding proteins (e.g., based upon leucine-rich repeats or ankyrin-rich repeats, such as DARPins). The ligand can be any cognate ligand of such ligand-binding domains.

In some embodiments of any of the aspects, the sequestering domain of the polypeptide is a nuclear export signal (NES). A nuclear export signal (NES) is a short target peptide containing 4 hydrophobic residues in a protein that targets it for export from the cell nucleus to the cytoplasm through the nuclear pore complex using nuclear transport. It has the opposite effect of a nuclear localization signal, which targets a protein located in the cytoplasm for import to the nucleus. The NES can be recognized and bound by exportins.

In some embodiments of any of the aspects, a polypeptide as described herein (or a polypeptide system collectively) comprises 1, 2, 3, 4, 5, or more NES(s). In some embodiments of any of the aspects, the polypeptide or system comprises one NES. In some embodiments of any of the aspects, a first polypeptide or second polypeptide as described herein further comprises at least one nuclear export signal (NES). In some embodiments of any of the aspects, the polypeptide or system comprises two NES's. In some embodiments of any of the aspects, a first polypeptide or second polypeptide as described herein further comprises at least two nuclear export signals (NES). In embodiments comprising multiple NES's, the multiple NES's can be different individual NES's or multiple copies of the same NES, or a combination of the foregoing. In some embodiments of any of the aspects, the NES is at the N-terminus of the polypeptide. In some embodiments of any of the aspects, the NES is at the C-terminus of the polypeptide. In some embodiments of any of the aspects, the NES is at an internal position of the polypeptide (e.g., in between two domains; e.g., in between ERT and another domain).

In some embodiments of any of the aspects, the NES comprises HIV-1 Rev NES (LPPLERLTL, SEQ ID NO: 192). In some embodiments of any of the aspects, the NES comprises H. sapiens focal adhesion kinase NES (LDLASLIL, SEQ ID NO: 2168). In some embodiments of any of the aspects, the sequestering protein comprises SEQ ID NO: 192 or SEQ ID NO: 2168 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 192 or SEQ ID NO: 2168 that maintains the same function.

In some embodiments of any of the aspects, the sequestering domain of the polypeptide is a nuclear localization signal (NLS). A nuclear localization signal or sequence (NLS) is an amino acid sequence that tags a protein for import into the cell nucleus by nuclear transport. Typically, this signal consists of one or more short sequences of positively charged lysines or arginines exposed on the protein surface. Different nuclear localized proteins may share the same NLS. An NLS has the opposite function of a nuclear export signal (NES), which targets proteins out of the nucleus. The NES can be recognized and bound by importins.

In some embodiments of any of the aspects, a polypeptide as described herein (or a polypeptide system collectively) comprises 1, 2, 3, 4, 5, or more NLS(s). In some embodiments of any of the aspects, the polypeptide or system comprises one NLS. In some embodiments of any of the aspects, a first polypeptide or second polypeptide as described herein further comprises at least one NLS. In some embodiments of any of the aspects, the polypeptide or system comprises two NLS's. In some embodiments of any of the aspects, a first polypeptide or second polypeptide as described herein further comprises at least two NLS's. In embodiments comprising multiple NLS's, the multiple NLS's can be different individual NLS's or multiple copies of the same NLS, or a combination of the foregoing. In some embodiments of any of the aspects, the NLS is at the N-terminus of the polypeptide. In some embodiments of any of the aspects, the NLS is at the C-terminus of the polypeptide. In some embodiments of any of the aspects, the NLS is at an internal position of the polypeptide (e.g., in between two domains; e.g., in between ERT and another domain).

In some embodiments of any of the aspects, the NLS comprises simian virus 40 (SV40) NLS (PKKKRKV, SEQ ID NO: 193) or nucleoplasmin (NPM2) NLS (KRVAPQKQMSIAKKKKV, SEQ ID NO: 194). In some embodiments of any of the aspects, the sequestering protein comprises SEQ ID NO: 193 or 194 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NO: 193 or 194 that maintains the same function.

In some embodiments of any of the aspects, a polypeptide or system comprising at least one NLS and no NES is transported into the nucleus. In some embodiments of any of the aspects, a polypeptide or system comprising more NLS's than NES's is transported into the nucleus. In some embodiments of any of the aspects, a polypeptide or system comprising a stronger NLS(s) compared to a weaker NES(s) is transported into the nucleus.

In some embodiments of any of the aspects, a polypeptide or system comprising at least one NES and no NLS is not transported into the nucleus and/or remains in the cytoplasm. In some embodiments of any of the aspects, a polypeptide or system comprising more NES's than NLS's is not transported into the nucleus and/or remains in the cytoplasm. In some embodiments of any of the aspects, a polypeptide or system comprising a stronger NES(s) compared to a weaker NLS(s) not transported into the nucleus and/or remains in the cytoplasm.

In some embodiments of any of the aspects, a polypeptide described herein that comprises a NES can have the NES removed. In some embodiments of any of the aspects, a polypeptide described herein that comprises a NES can have the NES replaced with a different NES, as known in the art or described herein. In some embodiments of any of the aspects, a polypeptide described herein that in one embodiment comprises a NES can have the NES replaced with an NLS, as known in the art or described herein.

In some embodiments of any of the aspects, a polypeptide described herein that comprises a NLS can have the NLS removed. In some embodiments of any of the aspects, a polypeptide described herein that comprises a NLS can have the NLS replaced with a different NLS, as known in the art or described herein. In some embodiments of any of the aspects, a polypeptide described herein that in one embodiment comprises a NLS can have the NLS replaced with an NES, as known in the art or described herein.

In several aspects, described herein are polypeptides comprising at least one linker peptide. As used herein "linker peptide" (used interchangeably with "peptide linker") refers to an oligo- or polypeptide region from about 2 to 100 amino acids in length, which links together any of the sequences of the polypeptides as described herein. In some embodiment, linkers can include or be composed of flexible residues such as glycine and serine so that the adjacent protein domains are free to move relative to one another. Longer linkers may be used when it is desirable to ensure that two adjacent domains do not sterically interfere with one another. Linkers may be cleavable or non-cleavable.

In some embodiments of any of the aspects, a polypeptide as described herein (or a polypeptide system collectively) comprises 1, 2, 3, 4, 5, or more linker peptide(s). In some embodiments of any of the aspects, the polypeptide or system comprises one linker peptide. In embodiments comprising multiple linker peptides, the multiple linker peptides can be different individual linker peptides or multiple copies of the same linker peptide, or a combination of the foregoing. In some embodiments of any of the aspects, the linker peptide can be positioned anywhere, between any two domains as described herein: e.g., between a polypeptide fragment of a nuclease or recombinase and an inducible dimerization domain, repressible dimerization domain, sequestering domain, a polypeptide fragment of a recombinase or nuclease, or any combination thereof. In some embodiments of any of the aspects, the linker peptide can be positioned within a domain described herein, e.g., to link constituents of the domain.

Non-limiting examples of peptide linker molecules useful in the polypeptides described herein include glycine-rich peptide linkers (see, e.g., U.S. Pat. No. 5,908,626), wherein more than half of the amino acid residues are glycine. Preferably, such glycine-rich peptide linkers consist of about 20 or fewer amino acids. A linker molecule may also include non-peptide or partial peptide molecules. For instance, the peptides can be linked to peptides or other molecules using well known cross-linking molecules such as glutaraldehyde or EDC (Pierce, Rockford, Ill.).

Non-limiting examples of linker peptide include, but are not limited to: SGTS (SEQ ID NO: 129); GSGS (SEQ ID NO: 130); SSGGSGSGSSGGSGT (SEQ ID NO: 169); GSGSGSSGGS (SEQ ID NO: 195); GGSGG (SEQ ID NO: 196); GGGSG (SEQ ID NO: 197); CVRGS (SEQ ID NO: 198); GGGGSG (SEQ ID NO: 199), GGSGSGSAC (SEQ ID NO: 200), LEGGGGSGG (SEQ ID NO: 201), GGGGSGGT (SEQ ID NO: 202), SGGGSGGSGSS (SEQ ID NO: 1983); GSSGTGSGSGTS (SEQ ID NO: 203);

GGSGGS (SEQ ID NO: 204); GSSGSS (SEQ ID NO: 205); and SSGGSGSGSSGGS (SEQ ID NO: 1982).

Flexible linkers are generally composed of small, nonpolar or polar residues such as Gly, Ser and Thr. In one embodiment of any fusion protein described herein that includes a linker, the linker peptide comprises at least one amino acid that is Gly or Ser. In one embodiment of a fusion protein described herein that includes a linker, the linker is a flexible polypeptide between 1 and 25 residues in length. Common examples of flexible peptide linkers include (GGS)n, where n=1 to 8 (SEQ ID NO: 206, GGSGGSGGSGGSGGSGGSGGSGGS), or (Gly$_4$Ser)n repeat where n=1-8 (SEQ ID NO: 207, GGGGSGGGGSGGGGSGGGGSGGGGSGGGGSGGGGSGGGGS), preferably, n=3, 4, 5, or 6, that is (Gly-Gly-Gly-Gly-Ser)n (SEQ ID NO: 208, GGGGS) where n indicates the number of repeats of the motif. For example, the flexible linker is (GGS)$_2$ (SEQ ID NO: 204, GGSGGS). Alternatively, flexible peptide linkers include Gly-Ser repeats (Gly-Ser)$_p$ where p indicates the number of Gly-Ser repeats of the motif, p=1-8 (SEQ ID NO: 209 GSGSGSGSGSGSGSGS), preferably, n=3, 4, 5, or 6. Another example of a flexible linker is TGSQK (SEQ ID NO: 210).

In some embodiments of any of the aspects, the linker peptide is about 1-20 amino acids long. In one embodiment, the linker peptide does not comprise Lys, or does not comprise, or does not comprise both Lys and Arg.

In some embodiments of any of the aspects, the domains or polypeptides described herein are joined together using chemical cross-linking agents. Bifunctional cross-linking molecules are linker molecules that possess two distinct reactive sites. For example, one of the reactive sites of a bifunctional linker molecule may be reacted with a functional group on a peptide to form a covalent linkage and the other reactive site may be reacted with a functional group on another molecule to form a covalent linkage. General methods for cross-linking molecules have been reviewed (see, e.g., Means and Feeney, Bioconjugate Chem., 1: 2-12 (1990)).

Homobifunctional cross-linker molecules have two reactive sites which are chemically the same. Non-limiting examples of homobifunctional cross-linker molecules include, without limitation, glutaraldehyde; N,N'-bis(3-maleimido-propionyl-2-hydroxy-1,3-propanediol (a sulfhydryl-specific homobifunctional cross-linker); certain N-succinimide esters (e.g., discuccinimyidyl suberate, dithiobis (succinimidyl propionate), and soluble bis-sulfonic acid and salt thereof (see, e.g., Pierce Chemicals, Rockford, Ill.; Sigma-Aldrich Corp., St. Louis, Mo.).

A bifunctional cross-linker molecule is a heterobifunctional linker molecule, meaning that the linker has at least two different reactive sites, each of which can be separately linked to a peptide or other molecule. Use of such heterobifunctional linkers permits chemically separate and stepwise addition (vectorial conjunction) of each of the reactive sites to a selected peptide sequence. Heterobifunctional linker molecules useful in the disclosure include, without limitation, m-maleimidobenzoyl-N-hydroxysuccinimide ester (see, Green et al., Cell, 28: 477-487 (1982); Palker et al., Proc. Natd. Acad. Sci (USA), 84: 2479-2483 (1987)); m-maleimido-benzoylsulfosuccinimide ester; maleimidobutyric acid N-hydroxysuccinimide ester; and N-succinimidyl 3-(2-pyridyl-dithio)propionate (see, e.g., Carlos et al., Biochem. J., 173: 723-737 (1978); Sigma-Aldrich Corp., St. Louis, Mo.).

In several aspects, described herein are polypeptides or systems comprising a self-cleaving peptide. As used herein, the term "self-cleaving peptide" refers to a short amino acid sequence (e.g., approximately 18-22 aa-long peptides) that can catalyze its own cleavage. In some embodiments of any of the aspects, a multi-component system as described herein comprises at least two polypeptides that are physically linked to one another through a self-cleaving peptide domain. The self-cleaving peptide allows the nucleic acids of the first polypeptide and second polypeptide (and/or third polypeptide, etc.) to be present in the same vector, but after translation the self-cleaving peptide cleaves the translated polypeptide into the multiple separate polypeptides.

In some embodiments of any of the aspects, a polypeptide as described herein (or a polypeptide system collectively) comprises 1, 2, 3, 4, 5, or more self-cleaving peptides, e.g., in between each polypeptide. In some embodiments of any of the aspects, the polypeptide or system comprises one self-cleaving peptide, e.g., in between a first polypeptide and a second polypeptide of a polypeptide system. In embodiments comprising multiple self-cleaving peptides, the multiple self-cleaving peptides can be different individual self-cleaving peptides or multiple copies of the same self-cleaving peptide, or a combination of the foregoing.

In some embodiments of any of the aspects, the self-cleaving peptide belongs to the 2A peptide family, which can also be referred to as a 2A Ribosomal Skip Sequence. Following translation of the polypeptide, the 2A sequence self-cleaves the polypeptide into two polypeptides. Non-limiting examples of 2A peptides include P2A, E2A, F2A and T2A (see e.g., Table 16). F2A is derived from foot-and-mouth disease virus 18; E2A is derived from equine rhinitis A virus; P2A is derived from porcine teschovirus-1 2A; T2A is derived from thosea asigna virus 2A. In some embodiments of any of the aspects, the N-terminal of the 2A peptide comprises the sequence "GSG" (Gly-Ser-Gly). In some embodiments of any of the aspects, the N-terminal of the 2A peptide does not comprise the sequence "GSG" (Gly-Ser-Gly).

TABLE 16

Exemplary Self-Cleaving Peptides

| SEQ ID NO: | Name | Sequence |
|---|---|---|
| 211 | T2A | (GSG) EGRGSLLTCGDVEENPGP |
| 212 | P2A | (GSG) ATNFSLLKQAGDVEENPGP |
| 213 | E2A | (GSG) QCTNYALLKLAGDVESNPGP |
| 214 | F2A | (GSG) VKQTLNFDLLKLAGDVESNPGP |

The 2A-peptide-mediated cleavage commences after protein translation. The cleavage is triggered by breaking of peptide bond between the Proline (P) and Glycine (G) in the C-terminal of the 2A peptide. The molecular mechanism of 2A-peptide-mediated cleavage involves ribosomal "skipping" of glycyl-prolyl peptide bond formation rather than true proteolytic cleavage. Different 2A peptides have different efficiencies of self-cleaving, with P2A being the most efficient and F2A the least efficient. Therefore, up to 50% of F2A-linked proteins can remain in the cell as a fusion protein.

In some embodiments of any of the aspects, the self-cleaving peptide of a polypeptide system as described herein comprises one of SEQ ID NOs: 211-214, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 211-214, that maintains the same function (e.g., self-cleavage).

In some embodiments of any of the aspects, providing the multiple polypeptides of the systems as described herein in a 1:1 (or 1:1:1, etc.) stoichiometric ratio is advantageous (e.g., this stoichiometric ratio results in optimal functionality). In embodiments where a 1:1 (or 1:1:1, etc.) ratio of the first and second (and third etc.) polypeptides of a system is advantageous, then the first and second polypeptides can be provided in a single vector, flanking a self-cleaving peptide (s) as described herein. In embodiments where a 1:1 (or 1:1:1, etc.) ratio of the first and second (and third etc.) polypeptides of a system is not advantageous (e.g., this stoichiometric ratio results in suboptimal functionality, and other ratios result in optimal functionality) then the first and second polypeptides can be provided in multiple separate vectors, e.g., at the desired stoichiometric ratios.

In several aspects, described herein are polypeptides comprising at least one detectable marker. As used herein, the term "detectable marker" refers to a moiety that, when attached to the polypeptide, confers detectability upon that polypeptide or another molecule to which the polypeptide binds. In some embodiments of any of the aspects, the polypeptide (or the polypeptide system collectively) comprises 1, 2, 3, 4, 5, or more detectable markers. In some embodiments of any of the aspects, the polypeptide or system comprises one detectable marker. In embodiments comprising multiple detectable markers, the multiple detectable markers can be different individual detectable markers or multiple copies of the same detectable markers, or a combination of the foregoing.

In some embodiments of any of the aspects, fluorescent moieties can be used as detectable markers, but detectable markers also include, for example, isotopes, fluorescent proteins and peptides, enzymes, components of a specific binding pair, chromophores, affinity tags as defined herein, antibodies, colloidal metals (i.e. gold) and quantum dots. Detectable markers can be either directly or indirectly detectable. Directly detectable markers do not require additional reagents or substrates in order to generate detectable signal. Examples include isotopes and fluorophores. Indirectly detectable markers require the presence or action of one or more co-factors or substrates. Examples include enzymes such as β-galactosidase which is detectable by generation of colored reaction products upon cleavage of substrates such as the chromogen X-gal (5-bromo-4-chloro-3-indoyl-β-D-galactopyranoside), horseradish peroxidase which is detectable by generation of a colored reaction product in the presence of the substrate diaminobenzidine and alkaline phosphatase which is detectable by generation of colored reaction product in the presence of nitroblue tetrazolium and 5-bromo-4-chloro-3-indolyl phosphate, and affinity tags. Non-limiting examples of affinity tags include Strep-tags, chitin binding proteins (CBP), maltose binding proteins (MBP), glutathione-S-transferase (GST), FLAG-tags, HA-tags, Myc-tags, poly(His)-tags as well as derivatives thereof. In some embodiments of any of the aspects, the detectable marker is selected from GFP, msGFP, V5, HA1, Myc, VSV-G, HSV, FLAG, HIS, mCherry, AU1, and biotin.

3X FLAG Tag + Nuclear Localization Sequence
(in bold text)
SEQ ID NO: 215
DYKDHDGDYKDHDIDYKDDDDKMAPKKKRKVGIHGVPGG, AU1 tag,
SEQ ID NO: 216
DTYRYI, HA tag,
SEQ ID NO: 217
YPYDVPDYA, FLAG Tag,
SEQ ID NO: 218
DYKDDDDK, mCherry:
SEQ ID NO: 219
VSKGEEDNMAIIKEFMRFKVHMEGSVNGHEFEIEGEGEGRPYEGTQTA

KLKVTKGGPLPFAWDILSPQFMYGSKAYVKHPADIPDYLKLSFPEGFK

WERVMNFEDGGVVTVTQDSSLQDGEFIYKVKLRGTNFPSDGPVMQKKT

MGWQASSERMYPEDGALKGEIKQRLKLKDGGHYDAEVKTTYKAKKPVQ

LPGAYNVNIKLDITSHNEDYTIVEQYERAEGRHSTGGMDELYK, huEGFRt (a truncated human EGFR polypeptide)
SEQ ID NO: 220
RKVCNGIGIGEFKDSLSINATNIKHFKNCTSISGDLHILPVAFRGDSF

THTPPLDPQELDILKTVKEITGFLLIQAWPENRTDLHAFENLEIIRGR

TKQHGQFSLAVVSLNITSLGLRSLKEISDGDVIISGNKNLCYANTINW

KKLFGTSGQKTKIISNRGENSCKATGQVCHALCSPEGCWGPEPRDCVS

CRNVSRGRECVDKCNLLEGEPREFVENSECIQCHPECLPQAMNITCTG

RGPDNCIQCAHYIDGPHCVKTCPAGVMGENNTLVWKYADAGHVCHLCH

PNCTYGCTGPGLEGCPTNGPKIPSIATGMVGALLLLLVVALGIGLFM, msGFP, a monomeric super-folder derivative of
EGFP, bolded text indicates an optional linker
SEQ ID NO: 2169
GGGGSGGGGSGGGGSVSKGEELFTGVVPILVELDGDVNGHKFSVRGEG

EGDATNGKLTLKFICTTGKLPVPWPTLVTTLTYGVQCFSRYPDHMKQH

DFFKSAMPEGYVQERTISFKDDGTYKTRAEVKFEGDTLVNRIELKGID

FKEDGNILGHKLEYNFNSHNVYITADKQKNGIKANFKIRHNVEDGSVQ

LADHYQQNTPIGDGPVLLPDNHYLSTQSKLSKDPNEKRDHMVLLEFVT

AAGITLGMDELYKGSEGA,

In some embodiments of any of the aspects, the detectable marker of a polypeptide as described herein comprises one of SEQ ID NOs: 215-220, 2169, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: SEQ ID NOs: 215-220, or 2169, that maintains the same (e.g., detection of the polypeptide or fragments thereof).

In some embodiments of any of the aspects, the detectable marker can be located anywhere within a polypeptide as described herein. In one embodiment, the detectable marker is located between any domain of a polypeptide as described herein, but is not found within a functional domain or does not disrupt the function of a domain. In some embodiments of any of the aspects, the detectable marker is located on the N terminus or C terminus. Such a marker can be used to detect the expression of the polypeptide, including cytosolic expression or nuclear translocation. In some embodiments of any of the aspects, the detectable marker is located between the repressible protease and a protease cleavage site; such a marker can be used to detect the cleavage and/or expression of the polypeptide.

In some embodiments of any of the aspects, polypeptides as described herein, especially those that are administered to a subject or those that are part of a pharmaceutical composition, do not comprise detectable markers that are immunogenic. In some embodiments of any of the aspects, polypeptides as described herein do not comprise GFP, mCherry, HA1, or any other immunogenic markers. In some embodiments of any of the aspects, a polypeptide described herein that comprises a detectable marker can have the detectable marker removed. In some embodiments of any of the aspects, a polypeptide described herein that comprises a detectable marker can have the detectable marker replaced with a different detectable marker, as known in the art or described herein.

In multiple aspects, described here are the following polypeptide systems: inducible dimerization domain systems; repressible dimerization domain systems; inducible nuclease split-recombinase systems; sequestering domain systems; and inducible promoter systems. In some embodiments of any of the aspects, a system can comprise any combination of the types of polypeptides or systems described herein. Table 17 below shows non-limiting examples of such combinations.

TABLE 17

Polypeptide Systems.

| ID | RE | IN | S | Q |
|----|----|----|---|---|
| X  |    |    |   |   |
|    | X  |    |   |   |
| X  | X  |    |   |   |
|    |    | X  |   |   |
| X  |    | X  |   |   |
|    | X  | X  |   |   |
| X  | X  | X  |   |   |
|    |    |    | X |   |
| X  |    |    | X |   |
|    | X  |    | X |   |
| X  | X  |    | X |   |
|    |    | X  | X |   |
| X  |    | X  | X |   |
|    | X  | X  | X |   |
| X  | X  | X  | X |   |
|    |    |    |   | X |
| X  |    |    |   | X |
|    | X  |    |   | X |
| X  | X  |    |   | X |
|    |    | X  |   | X |
| X  |    | X  |   | X |
|    | X  | X  |   | X |
| X  | X  | X  |   | X |
|    |    |    | X | X |
| X  |    |    | X | X |
|    | X  |    | X | X |
| X  | X  |    | X | X |
|    |    | X  | X | X |
| X  |    | X  | X | X |
|    | X  | X  | X | X |
| X  | X  | X  | X | X |

"ID" indicates inducible dimerization domain systems as described herein. "RE" indicates repressible dimerization domain systems as described herein. "IN" indicates inducible nuclease split-recombinase systems as described herein. "SQ" indicates sequestering domain systems as described herein. "IP" indicates inducible promoter systems as described herein.

In multiple aspects, described herein are polypeptide systems that are induced or repressed by an agent or signal. In some embodiments of any of the aspects, the examples shown in Table 17 can be in combination with an inducer agent as described herein (e.g., caffeine, abscisic acid, rapamycin, gibberellin, protease inhibitor, or analogs thereof), an inducer signal as described herein (e.g., light), a repressor agent (e.g., protease inhibitor), or bound to or specifically bound to the inducer or repressor agent. In some embodiments of any of the aspects, the inducer agent or signal can activate specific polypeptide systems (e.g., inducible dimerization domain systems). In some embodiments of any of the aspects, the repressor agent or signal can inactivate specific polypeptide systems (e.g., repressible dimerization domain systems).

In multiple aspects, described herein are polypeptide systems that are induced by a guide nucleic acid. In some embodiments of any of the aspects, the examples shown in Table 17 can be in combination with a guide nucleic acid that binds to a sequence-specific nuclease as described herein, or bound to or specifically bound to the guide nucleic acid. In some embodiments of any of the aspects, guide nucleic acid can activate specific polypeptide systems (e.g., inducible nuclease split-recombinase systems).

In multiple aspects, described herein are polypeptide systems wherein the subcellular location can be controlled. In some embodiments of any of the aspects, the examples shown in Table 17 can be in combination with a ligand that binds to a cytosolic sequestering domain as described herein (e.g., 4OHT or analogs thereof), or bound to or specifically bound to the ligand. In some embodiments of any of the aspects, the ligand can influence the subcellular compartment (e.g., nucleus, cytoplasm, transmembrane, etc.) of the specific polypeptide systems (e.g., sequestering domain systems).

In multiple aspects, described herein are polypeptide systems wherein the expression of at least one of the polypeptides can be controlled. In some embodiments of any of the aspects, the examples shown in Table 17 can be in combination with an agent that binds to an inducible promoter as described herein (e.g., PMA, TGF-beta, TNFa, WNT or analogs thereof; e.g., doxycycline). In some embodiments of any of the aspects, the agent can activate expression of specific polypeptides or polypeptide systems (e.g., inducible promoter systems).

In several aspects described herein are inducible polypeptides and inducible polypeptide systems. In one aspect described herein is an inducible split-nuclease polypeptide system comprising: (a) a first polypeptide comprising: (i) a first member of an inducible dimerization domain ($D^1$); and (ii) a first polypeptide fragment of a sequence-specific nuclease ($N^1$); and (b) a second polypeptide comprising: (i) a second member of the inducible dimerization domain ($D^2$); and (ii) a second polypeptide fragment of the sequence-specific nuclease ($N^2$). In some embodiments of any of the aspects, the first and second members of the inducible dimerization domain come together in the presence of an inducer agent or inducer signal. In some embodiments of any of the aspects, the first and second members of the inducible dimerization domain come together results in protein complementation of the two nuclease polypeptide fragments to form the active nuclease protein, e.g., in the presence of the inducer agent or inducer signal.

In one aspect, described herein is a first polypeptide comprising: (i) a first member of an inducible dimerization domain ($D^1$); and (ii) a first polypeptide fragment of a sequence-specific nuclease ($N^1$). In some embodiments of any of the aspects, D is N-terminal to $N^1$. In some embodiments of any of the aspects, $D^1$ is C-terminal to $N^1$. In one aspect, described herein is a second polypeptide comprising: (i) a second member of an inducible dimerization domain (D²); and (ii) a second polypeptide fragment of a sequence-specific nuclease (N²). In some embodiments of any of the aspects, D² is N-terminal to N². In some embodiments of any of the aspects, D² is C-terminal to N².

In one aspect, described herein is an inducible split-recombinase polypeptide system comprising: (a) a first polypeptide comprising: (i) a first member of an inducible dimerization domain (D¹); and (ii) a first polypeptide fragment of a recombinase (R¹); and (b) a second polypeptide comprising: (i) a second member of the inducible dimerization domain (D²); and (ii) a second polypeptide fragment of the recombinase (R²). In some embodiments of any of the aspects, the first and second members of the inducible dimerization domain come together in the presence of an inducer agent or inducer signal. In some embodiments of any of the aspects, the first and second members of the inducible dimerization domain come together results in protein complementation of the two recombinase polypeptide fragments to form the active recombinase protein, e.g., in the presence of the inducer agent or inducer signal.

In one aspect, described herein is a first polypeptide comprising: (i) a first member of an inducible dimerization domain (D¹); and (ii) a first polypeptide fragment of a recombinase (R¹). In some embodiments of any of the aspects, D¹ is N-terminal to R¹. In some embodiments of any of the aspects, D¹ is C-terminal to R¹. In one aspect, described herein is a second polypeptide comprising: (i) a second member of an inducible dimerization domain (D²); and (ii) a second polypeptide fragment of a recombinase (R²). In some embodiments of any of the aspects, D² is N-terminal to R². In some embodiments of any of the aspects, D² is C-terminal to R².

Non-limiting examples of inducible polypeptide systems vectors, polynucleotides, or polypeptides are provided below in Tables 18-22. In Tables 18-22, "Vec." indicates vector. "Nuc." indicates polynucleotide. "Pep." indicates polynucleotide. "Vector Nuc" indicates the start and stop nucleotides of the polypeptide in the vector. Bolded sequences indicate exemplary embodiments that showed the highest performance in the tested conditions.

TABLE 18

Exemplary ABI-PYL Sequences.

| Plasmid Name and Description | SEQ ID NOs | | | Vector Nuc. | |
|---|---|---|---|---|---|
| | Vec. | Nuc. | Pep. | Start | End |
| CD304 PV1-RfxCas13d-N88-L1-ABI-NLS-BGHpA | 221 | 279 | 337 | 2218 | 3465 |
| CD305 PV1-PYL-L1-RfxCas13d-89C-NLS-BGHpA | 222 | 280 | 338 | 986 | 4261 |
| CD306 PV1-RfxCas13d-N177-L1-ABI-NLS-BGHpA | 223 | 281 | 339 | 4310 | 5824 |
| CD307 PV1-PYL-L1-RfxCas13d-178C-NLS-BGHpA | 224 | 282 | 340 | 4310 | 7318 |
| CD308 PV1-RfxCas13d-N384-L1-ABI-NLS-BGHpA | 225 | 283 | 341 | 4310 | 6445 |
| CD309 PV1-PYL-L1-RfxCas13d-385C-NLS-BGHpA | 226 | 284 | 342 | 4310 | 6697 |
| CD310 PV1-RfxCas13d-N456-L1-ABI-NLS-BGHpA | 227 | 285 | 343 | 4310 | 6661 |
| CD311 PV1-PYL-L1-RfxCas13d-457C-NLS-BGHpA | 228 | 286 | 344 | 1849 | 4020 |
| CD312 PV1-RfxCas13d-N559-L1-ABI-NLS-BGHpA | 229 | 287 | 345 | 660 | 3320 |
| CD313 PV1-PYL-L1-RfxCas13d-560C-NLS-BGHpA | 230 | 288 | 346 | 4310 | 6172 |
| CD314 PV1-RfxCas13d-N565-L1-ABI-NLS-BGHpA | 231 | 289 | 347 | 4310 | 6988 |
| CD315 PV1-PYL-L1-RfxCas13d-566C-NLS-BGHpA | 232 | 290 | 348 | 4310 | 6154 |
| CD316 PV1-RfxCas13d-N583-L1-ABI-NLS-BGHpA | 233 | 291 | 349 | 4310 | 7042 |
| CD317 PV1-PYL-L1-RfxCas13d-584C-NLS-BGHpA | 234 | 292 | 350 | 4310 | 6310 |
| CD318 PV1-RfxCas13d-N655-L1-ABI-NLS-BGHpA | 235 | 293 | 351 | 5823 | 583 |
| CD319 PV1-PYL-L1-RfxCas13d-656C-NLS-BGHpA | 236 | 294 | 352 | 5033 | 6607 |
| CD320 PV1-RfxCas13d-N684-L1-ABI-NLS-BGHpA | 237 | 295 | 353 | 2193 | 5228 |
| CD321 PV1-PYL-L1-RfxCas13d-685C-NLS-BGHpA | 238 | 296 | 354 | 4310 | 5797 |
| CD322 PV1-RfxCas13d-N747-L1-ABI-NLS-BGHpA | 239 | 297 | 355 | 4310 | 7534 |
| CD323 PV1-PYL-L1-RfxCas13d-748C-NLS-BGHpA | 240 | 298 | 356 | 4310 | 5608 |
| CD324 PV1-RfxCas13d-N769-L1-ABI-NLS-BGHpA | 241 | 299 | 357 | 4310 | 7600 |
| CD325 PV1-PYL-L1-RfxCas13d-770C-NLS-BGHpA | 242 | 300 | 358 | 4310 | 5542 |
| CD326 PV1-RfxCas13d-N795-L1-ABI-NLS-BGHpA | 243 | 301 | 359 | 4310 | 7678 |
| CD327 PV1-PYL-L1-RfxCas13d-796C-NLS-BGHpA | 244 | 302 | 360 | 4310 | 5464 |
| CD328 PV1-RfxCas13d-N807-L1-ABI-NLS-BGHpA | 245 | 303 | 361 | 4310 | 7714 |
| CD329 PV1-PYL-L1-RfxCas13d-808C-NLS-BGHpA | 246 | 304 | 362 | 3225 | 4343 |
| CD330 PV1-RfxCas13d-N903-L1-ABI-NLS-BGHpA | 247 | 305 | 363 | 4310 | 8002 |
| CD331 PV1-PYL-L1-RfxCas13d-904C-NLS-BGHpA | 248 | 306 | 364 | 2210 | 3040 |
| CD510 PV1-RfxCas13d-N149-L1ABI-NLS-BGHpA | 249 | 307 | 365 | 4310 | 5740 |
| CD511 PV1-PYL-L1-RfxCas13d-150C-NLS-BGHpA | 250 | 308 | 366 | 5032 | 8124 |
| CD512 PV1-RfxCas13d-N180-L1-ABI-NLS-BGHpA | 251 | 309 | 367 | 4310 | 5833 |
| CD513 PV1-PYL-L1-RfxCas13d-181C-NLS-BGHpA | 252 | 310 | 368 | 4310 | 7309 |
| CD514 PV1-RfxCas13d-N215-L1-ABI-NLS-BGHpA | 253 | 311 | 369 | 2668 | 4296 |
| CD515 PV1-PYL-L1-RfxCas13d-216C-NLS-BGHpA | 254 | 312 | 370 | 4310 | 7204 |
| CD516 PV1-RfxCas13d-N263-L1-ABI-NLS-BGHpA | 255 | 313 | 371 | 4310 | 6082 |
| CD517 PV1-PYL-L1-RfxCas13d-264C-NLS-BGHpA | 256 | 314 | 372 | 4310 | 7060 |
| CD518 PV1-RfxCas13d-N317-L1-ABI-NLS-BGHpA | 257 | 315 | 373 | 4310 | 6244 |
| CD519 PV1-PYL-L1-RfxCas13d-318C-NLS-BGHpA | 258 | 316 | 374 | 5087 | 7675 |
| CD520 PV1-RfxCas13d-N340-L1-ABI-NLS-BGHpA | 259 | 317 | 375 | 2441 | 4444 |
| CD521 PV1-PYL-L1-RfxCas13d-341C-NLS-BGHpA | 260 | 318 | 376 | 3352 | 5871 |
| CD522 PV1-RfxCas13d-N404-L1-ABI-NLS-BGHpA | 261 | 319 | 377 | 4310 | 6505 |
| CD523 PV1-PYL-L1-RfxCas13d-405C-NLS-BGHpA | 262 | 320 | 378 | 2929 | 5256 |
| CD524 PV1-RfxCas13d-N473-L1-ABI-NLS-BGHpA | 263 | 321 | 379 | 4951 | 7353 |
| CD525 PV1-PYL-L1-RfxCas13d-474C-NLS-BGHpA | 264 | 322 | 380 | 5119 | 7239 |
| CD526 PV1-RfxCas13d-N507-L1-ABI-NLS-BGHpA | 265 | 323 | 381 | 3555 | 6059 |
| CD527 PV1-PYL-L1-RfxCas13d-508C-NLS-BGHpA | 266 | 324 | 382 | 4310 | 6328 |
| CD528 PV1-RfxCas13d-N576L1-ABI-NLS-BGHpA | 267 | 325 | 383 | 4310 | 7021 |

TABLE 18-continued

Exemplary ABI-PYL Sequences.

| Plasmid Name and Description | Vec. | Nuc. | Pep. | Start | End |
|---|---|---|---|---|---|
| CD529 PV1-PYL-L1-RfxCas13d-577C-NLS-BGHpA | 268 | 326 | 384 | 4310 | 6121 |
| CD732 PV1-ABI-L1-Cas13-89C-BGHpA | 269 | 327 | 385 | 4303 | 7950 |
| CD733 PV1-Cas13N88-L1-PYL-NLS-BGHpA | 270 | 328 | 386 | 4303 | 5199 |
| CD734 PV1-ABI-L1-Cas13-560C-BGHpA | 271 | 329 | 387 | 4303 | 6537 |
| CD735 PV1-Cas13N559-L1-PYL-NLS-BGHpA | 272 | 330 | 388 | 4303 | 6612 |
| CD736 PV1-ABI-L1-Cas13-264C-BGHpA | 273 | 331 | 389 | 4303 | 7425 |
| CD737 PV1-Cas13N263-L1-PYL-NLS-BGHpA | 274 | 332 | 390 | 4303 | 5724 |
| CD738 PV1-ABI-L1-Cas13-508C-BGHpA | 275 | 333 | 391 | 4303 | 6693 |
| CD739 PV1-Cas13N507-L1-PYL-NLS-BGHpA | 276 | 334 | 392 | 4303 | 6456 |
| CD785 PV1-NES-RfxCas13d-N507-L1-ABI-NES-BGHpA | 277 | 335 | 393 | 3555 | 6086 |
| CD786 PV1-NLS-Lz-PYL-L1-RfxCas13d-508C-NLS-BGHpA | 278 | 336 | 394 | 4307 | 6373 |

TABLE 19

Exemplary FKBP-FRB Sequences.

| Plasmid Name and Description | Vec. | Nuc. | Pep. | Start | End |
|---|---|---|---|---|---|
| CD276 PV1-RfxCas13-N88-L1-FRB-NLS-BGHpA | 395 | 455 | 515 | 4310 | 4918 |
| CD277 PV1-FKBP-L1-RfxCas13d-89C-NLS-BGHpA | 396 | 456 | 516 | 5032 | 8070 |
| CD278 PV1-RfxCas13d-N177-L1-FRB-NLS-BGHpA | 397 | 457 | 517 | 4310 | 5185 |
| CD279 PV1-FKBP-L1-RfxCas13d-178C-NLS-BGHpA | 398 | 458 | 518 | 4310 | 7081 |
| CD280 PV1-RfxCas13d-N384-L1-FRB-NLS-BGHpA | 399 | 459 | 519 | 4310 | 5806 |
| CD281 PV1-FKBP-L1-RfxCas13d-385C-NLS-BGHpA | 400 | 460 | 520 | 4310 | 6460 |
| CD282 PV1-RfxCas13d-N456-L1-FRB-NLS-BGHpA | 401 | 461 | 521 | 4310 | 6022 |
| CD283 PV1-FKBP-L1-RfxCas13d-457C-NLS-BGHpA | 402 | 462 | 522 | 4310 | 6244 |
| CD284 PV1-RfxCas13d-N559-L1-FRB-NLS-BGHpA | 403 | 463 | 523 | 4310 | 6331 |
| CD285 PV1-FKBP-L1-RfxCas13d-560C-NLS-BGHpA | 404 | 464 | 524 | 4310 | 5935 |
| CD286 PV1-RfxCas13d-N565-L1-FRB-NLS-BGHpA | 405 | 465 | 525 | 4310 | 6349 |
| CD287 PV1-FKBP-L1-RfxCas13d-566C-NLS-BGHpA | 406 | 466 | 526 | 4310 | 5917 |
| CD288 PV1-RfxCas13d-N583-L1-FRB-NLS-BGHpA | 407 | 467 | 527 | 4310 | 6403 |
| CD289 PV1-FKBP-L1-RfxCas13d-584C-NLS-BGHpA | 408 | 468 | 528 | 4310 | 5863 |
| CD290 PV1-RfxCas13d-N655-L1-FRB-NLS-BGHpA | 409 | 469 | 529 | 4310 | 6619 |
| CD291 PV1-FKBP-L1-RfxCas13d-656C-NLS-BGHpA | 410 | 470 | 530 | 6485 | 1245 |
| CD292 PV1-RfxCas13d-N684-L1-FRB-NLS-BGHpA | 411 | 471 | 531 | 5551 | 311 |
| CD293 PV1-FKBP-L1-RfxCas13d-685C-NLS-BGHpA | 412 | 472 | 532 | 4310 | 5560 |
| CD294 PV1-RfxCas13d-N747-L1-FRB-NLS-BGHpA | 413 | 473 | 533 | 4310 | 6895 |
| CD295 PV1-FKBP-L1-RfxCas13d-748C-NLS-BGHpA | 414 | 474 | 534 | 4310 | 5371 |
| CD296 PV1-RfxCas13d-N769-L1-FRB-NLS-BGHpA | 415 | 475 | 535 | 2210 | 4861 |
| CD297 PV1-FKBP-L1-RfxCas13d-770C-NLS-BGHpA | 416 | 476 | 536 | 4310 | 5305 |
| CD298 PV1-RfxCas13d-N795-L1-FRB-NLS-BGHpA | 417 | 477 | 537 | 4310 | 7039 |
| CD299 PV1-FKBP-L1-RfxCas13d-796C-NLS-BGHpA | 418 | 478 | 538 | 4310 | 5227 |
| CD300 PV1-RfxCas13d-N807-L1-FRB-NLS-BGHpA | 419 | 479 | 539 | 4310 | 7075 |
| CD301 PV1-FKBP-L1-RfxCas13d-808C-NLS-BGHpA | 420 | 480 | 540 | 2024 | 2905 |
| CD302 PV1-RfxCas13d-N903-L1-FRB-NLS-BGHpA | 421 | 481 | 541 | 4310 | 7363 |
| CD303 PV1-FKBP-L1-RfxCas13d-904C-NLS-BGHpA | 422 | 482 | 542 | 4310 | 4903 |
| CD455 PV1-RfxCas13d-N149-L1-FRB-NLS-BGHpA | 423 | 483 | 543 | 4310 | 5101 |
| CD456 PV1-FKBP-L1-RfxCas13d-150C-NLS-BGHpA | 424 | 484 | 544 | 4310 | 7887 |
| CD457 PV1-RfxCas13d-N180-L1-FRB-NLS-BGHpA | 425 | 485 | 545 | 4310 | 5194 |
| CD458 PV1-FKBP-L1-RfxCas13d-181C-NLS-BGHpA | 426 | 486 | 546 | 4310 | 7072 |
| CD459 PV1-RfxCas13d-N215-L1-FRB-NLS-BGHpA | 427 | 487 | 547 | 2668 | 3657 |
| CD460 PV1-FKBP-L1-RfxCas13d-216C-NLS-BGHpA | 428 | 488 | 548 | 4310 | 6967 |
| CD461 PV1-RfxCas13d-N263-L1-FRB-NLS-BGHpA | 429 | 489 | 549 | 4310 | 5443 |
| CD462 PV1-FKBP-L1-RfxCas13d-264C-NLS-BGHpA | 430 | 490 | 550 | 4310 | 6823 |
| CD463 PV1-RfxCas13d-N317-L1-FRB-NLS-BGHpA | 431 | 491 | 551 | 4310 | 5605 |
| CD464 PV1-FKBP-L1-RfxCas13d-318C-NLS-BGHpA | 432 | 492 | 552 | 4310 | 7438 |
| CD465 PV1-RfxCas13d-N340-L1-FRB-NLS-BGHpA | 433 | 493 | 553 | 2441 | 3805 |
| CD466 PV1-FKBP-L1-RfxCas13d-341C-NLS-BGHpA | 434 | 494 | 554 | 3352 | 5634 |
| CD467 PV1-RfxCas13d-N404-L1-FRB-NLS-BGHpA | 435 | 495 | 555 | 4310 | 5866 |
| CD468 PV1-FKBP-L1-RfxCas13d-405C-NLS-BGHpA | 436 | 496 | 556 | 2929 | 5019 |
| CD469 PV1-RfxCas13d-N473-L1-FRB-NLS-BGHpA | 437 | 497 | 557 | 4951 | 6714 |
| CD470 PV1-FKBP-L1-RfxCas13d-474C-NLS-BGHpA | 438 | 498 | 558 | 5119 | 7002 |
| CD471 PV1-RfxCas13d-N507-L1-FRB-NLS-BGHpA | 439 | 499 | 559 | 3555 | 5420 |
| CD472 PV1-FKBP-L1-RfxCas13d-508C-NLS-BGHpA | 440 | 500 | 560 | 4310 | 6091 |
| CD473 PV1-RfxCas13d-N576L1-FRB-NLS-BGHpA | 441 | 501 | 561 | 4310 | 6382 |
| CD474 PV1-FKBP-L1-RfxCas13d-577C-NLS-BGHpA | 442 | 502 | 562 | 4310 | 5884 |
| CD475 PV1-RfxCas13d-N721-L1-FRB-NLS-BGHpA | 443 | 503 | 563 | 4136 | 6643 |
| CD476 PV1-FKBP-L1-RfxCas13d-722C-NLS-BGHpA | 444 | 504 | 564 | 4310 | 5449 |
| CD477 PV1-RfxCas13d-N755-L1-FRB-NLS-BGHpA | 445 | 505 | 565 | 2671 | 5280 |

TABLE 19-continued

Exemplary FKBP-FRB Sequences.

| Plasmid Name and Description | Vec. | SEQ ID NOs Nuc. | Pep. | Vector Nuc. Start | End |
|---|---|---|---|---|---|
| CD478 PV1-FKBP-L1-RfxCas13d-756C-NLS-BGHpA | 446 | 506 | 566 | 5130 | 6167 |
| CD479 PV1-RfxCas13d-N848-L1-FRB-NLS-BGHpA | 447 | 507 | 567 | 2672 | 5560 |
| CD480 PV1-FKBP-L1-RfxCas13d-849C-NLS-BGHpA | 448 | 508 | 568 | 2352 | 3110 |
| CD481 PV1-RfxCas13d-N877-L1-FRB-NLS-BGHpA | 449 | 509 | 569 | 4310 | 7285 |
| CD482 PV1-FKBP-L1-RfxCas13d-878C-NLS-BGHpA | 450 | 510 | 570 | 4310 | 4981 |
| CD485 PV1-NES-RfxCas13d-N559-L1-FRB-BGHpA | 451 | 511 | 571 | 4310 | 6334 |
| CD486 PV1-NLS-Lz-FKBP-RfxCas13d-560C-NLS-BGHpA | 452 | 512 | 572 | 5029 | 6702 |
| CD487 PV1-NES-RfxCas13d-N559-L1-FRB-NES-BGHpA | 453 | 513 | 573 | 4310 | 6358 |
| CD488 PV1-NLS-Lz-FKBP-RfxCas13d-560C-NLS-BGHpA | 454 | 514 | 574 | 5029 | 6720 |

TABLE 20

Exemplary GID-GAI Sequences.

| Plasmid Name and Description | Vec. | SEQ ID NOs Nuc. | Pep. | Vector Nuc. Start | End |
|---|---|---|---|---|---|
| CD235 PV1-RfxCas13d-N88-L1-GID-NLS-BGHpA | 575 | 655 | 735 | 4310 | 5677 |
| CD236 PV1-GAI-L1-RfxCas13d-89C-NLS-BGHpA | 576 | 656 | 736 | 5032 | 8016 |
| CD237 PV1-RfxCas13d-N177-L1-GID-NLS-BGHpA | 577 | 657 | 737 | 4310 | 5944 |
| CD238 PV1-GAI-L1-RfxCas13d-178C-NLS-BGHpA | 578 | 658 | 738 | 4310 | 7027 |
| CD239 PV1-RfxCas13d-N384-L1-GID-NLS-BGHpA | 579 | 659 | 739 | 6070 | 830 |
| CD240 PV1-GAI-L1-RfxCas13d-385C-NLS-BGHpA | 580 | 660 | 740 | 4310 | 6406 |
| CD241 PV1-RfxCas13d-N456-L1-GID-NLS-BGHpA | 581 | 661 | 741 | 4310 | 6781 |
| CD242 PV1-GAI-L1-RfxCas13d-457C-NLS-BGHpA | 582 | 662 | 742 | 4310 | 6190 |
| CD243 PV1-RfxCas13d-N559-L1-GID-NLS-BGHpA | 583 | 663 | 743 | 4310 | 7090 |
| CD244 PV1-GAI-L1-RfxCas13d-560C-NLS-BGHpA | 584 | 664 | 744 | 4310 | 5881 |
| CD245 PV1-RfxCas13d-N565-L1-GID-NLS-BGHpA | 585 | 665 | 745 | 2202 | 5000 |
| CD246 PV1-GAI-L1-RfxCas13d-566C-NLS-BGHpA | 586 | 666 | 746 | 4310 | 5863 |
| CD247 PV1-RfxCas13d-N583-L1-GID-NLS-BGHpA | 587 | 667 | 747 | 4310 | 7162 |
| CD248 PV1-GAI-L1-RfxCas13d-584C-NLS-BGHpA | 588 | 668 | 748 | 658 | 2157 |
| CD249 PV1-RfxCas13d-N655-L1-GID-NLS-BGHpA | 589 | 669 | 749 | 558 | 3626 |
| CD250 PV1-GAI-L1-RfxCas13d-656C-NLS-BGHpA | 590 | 670 | 750 | 4310 | 5593 |
| CD251 PV1-RfxCas13d-N684-L1-GID-NLS-BGHpA | 591 | 671 | 751 | 83 | 3238 |
| CD252 PV1-GAI-L1-RfxCas13d-685C-NLS-BGHpA | 592 | 672 | 752 | 4310 | 5506 |
| CD253 PV1-RfxCas13d-N747-L1-GID-NLS-BGHpA | 593 | 673 | 753 | 4310 | 7654 |
| CD254 PV1-GAI-L1-RfxCas13d-748C-NLS-BGHpA | 594 | 674 | 754 | 4310 | 5317 |
| CD255 PV1-RfxCas13d-N769-L1-GID-NLS-BGHpA | 595 | 675 | 755 | 7673 | 2433 |
| CD256 PV1-GAI-L1-RfxCas13d-770C-NLS-BGHpA | 596 | 676 | 756 | 4310 | 5521 |
| CD257 PV1-RfxCas13d-N795-L1-GID-NLS-BGHpA | 597 | 677 | 757 | 7784 | 2544 |
| CD258 PV1-GAI-L1-RfxCas13d-796C-NLS-BGHpA | 598 | 678 | 758 | 5130 | 5993 |
| CD259 PV1-RfxCas13d-N807-L1-GID-NLS-BGHpA | 599 | 679 | 759 | 6120 | 880 |
| CD260 PV1-GAI-L1-RfxCas13d-808C-NLS-BGHpA | 600 | 680 | 760 | 2352 | 3179 |
| CD261 PV1-RfxCas13d-N903-L1-GID-NLS-BGHpA | 601 | 681 | 761 | 4310 | 8122 |
| CD262 PV1-GAI-L1-RfxCas13d-904C-NLS-BGHpA | 602 | 682 | 762 | 4310 | 4849 |
| CD393 PV1-RfxCas13d-N149-L1-GID-NLS-BGHpA | 603 | 683 | 763 | 4310 | 5860 |
| CD394 PV1-GAI-L1-RfxCas13d-150C-NLS-BGHpA | 604 | 684 | 764 | 5032 | 7833 |
| CD395 PV1-RfxCas13d-N180-L1-GID-NLS-BGHpA | 605 | 685 | 765 | 4310 | 5953 |
| CD396 PV1-GAI-L1-RfxCas13d-181C-NLS-BGHpA | 606 | 686 | 766 | 4310 | 7018 |
| CD397 PV1-RfxCas13d-N215-L1-GID-NLS-BGHpA | 607 | 687 | 767 | 6070 | 830 |
| CD398 PV1-GAI-L1-RfxCas13d-216C-NLS-BGHpA | 608 | 688 | 768 | 4310 | 6913 |
| CD399 PV1-RfxCas13d-N263-L1-GID-NLS-BGHpA | 609 | 689 | 769 | 4310 | 6202 |
| CD400 PV1-GAI-L1-RfxCas13d-264C-NLS-BGHpA | 610 | 690 | 770 | 4310 | 6769 |
| CD401 PV1-RfxCas13d-N317-L1-GID-NLS-BGHpA | 611 | 691 | 771 | 4310 | 6364 |
| CD402 PV1-GAI-L1-RfxCas13d-318C-NLS-BGHpA | 612 | 692 | 772 | 5087 | 7384 |
| CD403 PV1-RfxCas13d-N340-L1-GID-NLS-BGHpA | 613 | 693 | 773 | 2202 | 4325 |
| CD404 PV1-GAI-L1-RfxCas13d-341C-NLS-BGHpA | 614 | 694 | 774 | 3352 | 5580 |
| CD405 PV1-RfxCas13d-N404-L1-GID-NLS-BGHpA | 615 | 695 | 775 | 4310 | 6625 |
| CD406 PV1-GAI-L1-RfxCas13d-405C-NLS-BGHpA | 616 | 696 | 776 | 2929 | 4965 |
| CD407 PV1-RfxCas13d-N473-L1-GID-NLS-BGHpA | 617 | 697 | 777 | 225 | 2747 |
| CD408 PV1-GAI-L1-RfxCas13d-474C-NLS-BGHpA | 618 | 698 | 778 | 4758 | 6587 |
| CD409 PV1-RfxCas13d-N507-L1-GID-NLS-BGHpA | 619 | 699 | 779 | 4806 | 7430 |
| CD410 PV1-GAI-L1-RfxCas13d-508C-NLS-BGHpA | 620 | 700 | 780 | 4310 | 6037 |
| CD411 PV1-RfxCas13d-N576L1-GID-NLS-BGHpA | 621 | 701 | 781 | 4310 | 7141 |
| CD412 PV1-GAI-L1-RfxCas13d-577C-NLS-BGHpA | 622 | 702 | 782 | 4310 | 5830 |
| CD413 PV1-RfxCas13d-N721-L1-GID-NLS-BGHpA | 623 | 703 | 783 | 4136 | 7402 |
| CD414 PV1-GAI-L1-RfxCas13d-722C-NLS-BGHpA | 624 | 704 | 784 | 4310 | 5395 |
| CD415 PV1-RfxCas13d-N755-L1-GID-NLS-BGHpA | 625 | 705 | 785 | 3952 | 7320 |
| CD416 PV1-GAI-L1-RfxCas13d-756C-NLS-BGHpA | 626 | 706 | 786 | 5130 | 6113 |
| CD417 PV1-RfxCas13d-N848-L1-GID-NLS-BGHpA | 627 | 707 | 787 | 6120 | 880 |

TABLE 20-continued

Exemplary GID-GAI Sequences.

| Plasmid Name and Description | SEQ ID NOs | | | Vector Nuc. | |
|---|---|---|---|---|---|
| | Vec. | Nuc. | Pep. | Start | End |
| CD418 PV1-GAI-L1-RfxCas13d-849C-NLS-BGHpA | 628 | 708 | 788 | 2352 | 3056 |
| CD419 PV1-RfxCas13d-N877-L1-GID-NLS-BGHpA | 629 | 709 | 789 | 4310 | 8044 |
| CD420 PV1-GAI-L1-RfxCas13d-878C-NLS-BGHpA | 630 | 710 | 790 | 4310 | 4927 |
| CD421 PV1-NES-RfxCas13d-N88-L1-GID-BGHpA | 631 | 711 | 791 | 4310 | 5680 |
| CD422 PV1-NLS-Lz-RfxCas13d-89C-NLS-BGHpA | 632 | 712 | 792 | 5029 | 8061 |
| CD423 PV1-NES-RfxCas13d-N88-L1-GID-NES-BGHpA | 633 | 713 | 793 | 4310 | 5704 |
| CD424 PV1-NLS-Lz-RfxCas13d-89C-*NLS-BGHpA | 634 | 714 | 794 | 5029 | 8079 |
| CD425 PV1-NES-RfxCas13d-N559-L1-GID-BGHpA | 635 | 715 | 795 | 4310 | 7093 |
| CD426 PV1-NLS-Lz-RfxCas13d-560C-NLS-BGHpA | 636 | 716 | 796 | 5029 | 6648 |
| CD427 PV1-NES-RfxCas13d-N559-L1-GID-NES-BGHpA | 637 | 717 | 797 | 4310 | 7117 |
| CD428 PV1-NLS-Lz-RfxCas13d-560C-*NLS-BGHpA | 638 | 718 | 798 | 5029 | 6666 |
| CD429 PV1-NES-RfxCas13d-N565-L1-GID-BGHpA | 639 | 719 | 799 | 4310 | 7111 |
| CD430 PV1-NLS-Lz-RfxCas13d-566C-NLS-BGHpA | 640 | 720 | 800 | 5029 | 6633 |
| CD431 PV1-NES-RfxCas13d-N565-L1-GID-NES-BGHpA | 641 | 721 | 801 | 4310 | 7135 |
| CD432 PV1-NLS-Lz-RfxCas13d-566C-*NLS-BGHpA | 642 | 722 | 802 | 5029 | 6648 |
| CD433 PV1-NES-RfxCas13d-N655-L1-GID-BGHpA | 643 | 723 | 803 | 4310 | 7381 |
| CD434 PV1-NLS-Lz-GAI-RfxCas13d-656C-NLS-BGHpA | 644 | 724 | 804 | 5029 | 6360 |
| CD435 PV1-NES-RfxCas13d-N655-L1-GID-NES-BGHpA | 645 | 725 | 805 | 4310 | 7405 |
| CD436 PV1-NLS-Lz-GAI-RfxCas13d-656C-*NLS-BGHpA | 646 | 726 | 806 | 5029 | 6378 |
| CD740_PV1-GID1-L1-Cas1389C-BGHpA | 647 | 727 | 807 | 4303 | 8067 |
| CD741_PV1-Cas13-N88-L1-GAI-NLS-BGHpA | 648 | 728 | 808 | 4303 | 4911 |
| CD742_PV1-GID1-L1-Cas13-560C-BGHpA | 649 | 729 | 809 | 4303 | 6654 |
| CD743_PV1-Cas13N559-L1-GAI-NLS-BGHpA | 650 | 730 | 810 | 4303 | 6324 |
| CD744_PV1-GID1-L1-Cas13-264C-BGHpA | 651 | 731 | 811 | 4303 | 7542 |
| CD745_PV1-Cas13N263-L1-GAI-NLS-BGHpA | 652 | 732 | 812 | 4303 | 5436 |
| CD746_PV1-GID1-L1-Cas13-508C-BGHpA | 653 | 733 | 813 | 4303 | 6810 |
| CD747_PV1-Cas13N507-L1-GAI-NLS-BGHpA | 654 | 734 | 814 | 4303 | 6168 |

TABLE 21

Exemplary LIDD Sequences.

| Plasmid | | SEQ ID NOs | | | Vector Nuc. | |
|---|---|---|---|---|---|---|
| Name | Description | Vec. | Nuc. | Pep. | Start | End |
| CT17N | pCAG-PV1-RfxCas13d-89C-BGHpA | 815 | 873 | 931 | 4303 | 7464 |
| CT17P | pCAG-PV1-RfxCas13d-89C-BGHpA | 816 | 874 | 932 | 4303 | 7464 |
| CT18N | pCAG-PV1-RfxCas13d-178C-BGHpA | 817 | 875 | 933 | 4303 | 7197 |
| CT18P | pCAG-PV1-RfxCas13d-178C-BGHpA | 818 | 876 | 934 | 4303 | 7197 |
| CT19N | pCAG-PV1-RfxCas13d-385C-BGHpA | 819 | 877 | 935 | 4303 | 6576 |
| CT19P | pCAG-PV1-RfxCas13d-385C-BGHpA | 820 | 878 | 936 | 4303 | 6576 |
| CT20N | pCAG-PV1-RfxCas13d-457C-BGHpA | 821 | 879 | 937 | 4303 | 6360 |
| CT20P | pCAG-PV1-RfxCas13d-457C-BGHpA | 822 | 880 | 938 | 4303 | 6360 |
| CT21N | pCAG-PV1-RfxCas13d-560C-BGHpA | 823 | 881 | 939 | 4303 | 6051 |
| CT21P | pCAG-PV1-RfxCas13d-560C-BGHpA | 824 | 882 | 940 | 4303 | 6051 |
| CT22N | pCAG-PV1-RfxCas13d-566C-BGHpA | 825 | 883 | 941 | 4303 | 6033 |
| CT22P | pCAG-PV1-RfxCas13d-566C-BGHpA | 826 | 884 | 942 | 4303 | 6033 |
| CT23N | pCAG-PV1-RfxCas13d-584C-BGHpA | 827 | 885 | 943 | 4303 | 5979 |
| CT23P | pCAG-PV1-RfxCas13d-584C-BGHpA | 828 | 886 | 944 | 4303 | 5979 |
| CT24N | pCAG-PV1-RfxCas13d-656C-BGHpA | 829 | 887 | 945 | 4303 | 5763 |
| CT24P | pCAG-PV1-RfxCas13d-656C-BGHpA | 830 | 888 | 946 | 4303 | 5763 |
| CT25N | pCAG-PV1-RfxCas13d-685C-BGHpA | 831 | 889 | 947 | 4303 | 5676 |
| CT25P | pCAG-PV1-RfxCas13d-685C-BGHpA | 832 | 890 | 948 | 4303 | 5676 |
| CT26N | pCAG-PV1-RfxCas13d-904C-BGHpA | 833 | 891 | 949 | 4303 | 5019 |
| CT26P | pCAG-PV1-RfxCas13d-904C-BGHpA | 834 | 892 | 950 | 4303 | 5019 |
| CT85N | pCAG-PV1-RfxCas13d-N88-BGHpA | 835 | 893 | 951 | 4303 | 5085 |
| CT85P | pCAG-PV1-RfxCas13d-N88-BGHpA | 836 | 894 | 952 | 4303 | 5085 |
| CT86N | pCAG-PV1-RfxCas13d-N177-BGHpA | 837 | 895 | 953 | 4303 | 5352 |
| CT86P | pCAG-PV1-RfxCas13d-N177-BGHpA | 838 | 896 | 954 | 4303 | 5352 |
| CT87N | pCAG-PV1-RfxCas13d-N384-BGHpA | 839 | 897 | 955 | 4303 | 5973 |
| CT87P | pCAG-PV1-RfxCas13d-N384-BGHpA | 840 | 898 | 956 | 4303 | 5973 |
| CT88N | pCAG-PV1-RfxCas13d-N559-BGHpA | 841 | 899 | 957 | 4303 | 6498 |
| CT88P | pCAG-PV1-RfxCas13d-N559-BGHpA | 842 | 900 | 958 | 4303 | 6498 |
| CT89N | pCAG-PV1-RfxCas13d-N565-BGHpA | 843 | 901 | 959 | 4303 | 6516 |
| CT89P | pCAG-PV1-RfxCas13d-N565-BGHpA | 844 | 902 | 960 | 4303 | 6516 |
| CT90N | pCAG-PV1-RfxCas13d-N583-BGHpA | 845 | 903 | 961 | 4303 | 6570 |
| CT90P | pCAG-PV1-RfxCas13d-N583-BGHpA | 846 | 904 | 962 | 4303 | 6570 |
| CT91N | pCAG-PV1-RfxCas13d-N655-BGHpA | 847 | 905 | 963 | 4303 | 6786 |
| CT91P | pCAG-PV1-RfxCas13d-N655-BGHpA | 848 | 906 | 964 | 4303 | 6786 |
| CT92N | pCAG-PV1-RfxCas13d-N684-BGHpA | 849 | 907 | 965 | 4303 | 6873 |

TABLE 21-continued

Exemplary LIDD Sequences.

| Plasmid | | SEQ ID NOs | | | Vector Nuc. | |
|---|---|---|---|---|---|---|
| Name | Description | Vec. | Nuc. | Pep. | Start | End |
| CT92P | pCAG-PV1-RfxCas13d-N684-BGHpA | 850 | 908 | 966 | 4303 | 6873 |
| CT93N | pCAG-PV1-RfxCas13d-N903-BGHpA | 851 | 909 | 967 | 4303 | 7530 |
| CT93P | pCAG-PV1-RfxCas13d-N903-BGHpA | 852 | 910 | 968 | 4303 | 7530 |
| CT95N | pCAG-PV1-RfxCas13d-150C-BGHpA | 853 | 911 | 969 | 4303 | 7302 |
| CT95P | pCAG-PV1-RfxCas13d-150C-BGHpA | 854 | 912 | 970 | 4303 | 7302 |
| CT96N | pCAG-PV1-RfxCas13d-181C-BGHpA | 855 | 913 | 971 | 4303 | 7209 |
| CT96P | pCAG-PV1-RfxCas13d-181C-BGHpA | 856 | 914 | 972 | 4303 | 7209 |
| CT97N | pCAG-PV1-RfxCas13d-216C-BGHpA | 857 | 915 | 973 | 4303 | 7104 |
| CT97P | pCAG-PV1-RfxCas13d-216C-BGHpA | 858 | 916 | 974 | 4303 | 7104 |
| CT98N | pCAG-PV1-RfxCas13d-264C-BGHpA | 859 | 917 | 975 | 4303 | 6960 |
| CT98P | pCAG-PV1-RfxCas13d-264C-BGHpA | 860 | 918 | 976 | 4303 | 6960 |
| CT99N | pCAG-PV1-RfxCas13d-318C-BGHpA | 861 | 919 | 977 | 4303 | 6798 |
| CT99P | pCAG-PV1-RfxCas13d-318C-BGHpA | 862 | 920 | 978 | 4303 | 6798 |
| CT100N | pCAG-PV1-RfxCas13d-341C-BGHpA | 863 | 921 | 979 | 4303 | 6729 |
| CT100P | pCAG-PV1-RfxCas13d-341C-BGHpA | 864 | 922 | 980 | 4303 | 6729 |
| CT101N | pCAG-PV1-RfxCas13d-405C-BGHpA | 865 | 923 | 981 | 4303 | 6537 |
| CT101P | pCAG-PV1-RfxCas13d-405C-BGHpA | 866 | 924 | 982 | 4303 | 6537 |
| CT102N | pCAG-PV1-RfxCas13d-474C-BGHpA | 867 | 925 | 983 | 4303 | 6330 |
| CT102P | pCAG-PV1-RfxCas13d-474C-BGHpA | 868 | 926 | 984 | 4303 | 6330 |
| CT103N | pCAG-PV1-RfxCas13d-508C-BGHpA | 869 | 927 | 985 | 4303 | 6228 |
| CT103P | pCAG-PV1-RfxCas13d-508C-BGHpA | 870 | 928 | 986 | 4303 | 6228 |
| CT104N | pCAG-PV1-RfxCas13d-577C-BGHpA | 871 | 929 | 987 | 4303 | 6021 |
| CT104P | pCAG-PV1-RfxCas13d-577C-BGHpA | 872 | 930 | 988 | 4303 | 6021 |

In the plasmid name, "N" indicates the polypeptide comprises N-mag, and "P" indicates the polypeptide comprises P-mag.

TABLE 22

Exemplary Reader and Repressible Protease Sequences.

| Plasmid Name and Description | SEQ ID NOs | | | Vector Nuc. | |
|---|---|---|---|---|---|
| | Vec. | Nuc. | Pep. | Start | End |
| CD570 PV1-RfxCas13d-N149-L1-dNS31a-NLS-BGHpA | 989 | 1067 | 1145 | 4310 | 5443 |
| CD571 PV1-RfxCas13d-N180-L1-dNS31a-NLS-BGHpA | 990 | 1068 | 1146 | 4310 | 5536 |
| CD572 PV1-RfxCas13d-N215-L1-dNS31a-NLS-BGHpA | 991 | 1069 | 1147 | 2668 | 3999 |
| CD573 PV1-RfxCas13d-N263-L1-dNS31a-NLS-BGHpA | 992 | 1070 | 1148 | 4310 | 5785 |
| CD574 PV1-RfxCas13d-N317-L1-dNS31a-NLS-BGHpA | 993 | 1071 | 1149 | 4310 | 5947 |
| CD575 PV1-RfxCas13d-N340-L1-dNS31a-NLS-BGHpA | 994 | 1072 | 1150 | 2441 | 4147 |
| CD576 PV1-RfxCas13d-N404-L1-dNS31a-NLS-BGHpA | 995 | 1073 | 1151 | 4310 | 6208 |
| CD577 PV1-RfxCas13d-N473-L1-dNS31a-NLS-BGHpA | 996 | 1074 | 1152 | 4951 | 7056 |
| CD578 PV1-RfxCas13d-N507-L1-dNS31a-NLS-BGHpA | 997 | 1075 | 1153 | 3555 | 5762 |
| CD579 PV1-RfxCas13d-N576-L1-dNS31a-NLS-BGHpA | 998 | 1076 | 1154 | 4310 | 6724 |
| CD580 PV1-GNCR-L1-RfxCas13d-150C-NLS-BGHpA | 999 | 1077 | 1155 | 5032 | 8259 |
| CD581 PV1-GNCR-L1-RfxCas13d-181C-NLS-BGHpA | 1000 | 1078 | 1156 | 5523 | 283 |
| CD582 PV1-GNCR-L1-RfxCas13d-216C-NLS-BGHpA | 1001 | 1079 | 1157 | 4310 | 7339 |
| CD583 PV1-GNCR-L1-RfxCas13d-264C-NLS-BGHpA | 1002 | 1080 | 1158 | 5939 | 699 |
| CD584 PV1-GNCR-L1-RfxCas13d-318C-NLS-BGHpA | 1003 | 1081 | 1159 | 5212 | 7935 |
| CD585 PV1-GNCR-L1-RfxCas13d-341C-NLS-BGHpA | 1004 | 1082 | 1160 | 3352 | 5925 |
| CD586 PV1-GNCR-L1-RfxCas13d-405C-NLS-BGHpA | 1005 | 1083 | 1161 | 2929 | 5391 |
| CD587 PV1-GNCR-L1-RfxCas13d-474C-NLS-BGHpA | 1006 | 1084 | 1162 | 5114 | 7374 |
| CD588 PV1-GNCR-L1-RfxCas13d-508C-NLS-BGHpA | 1007 | 1085 | 1163 | 4310 | 6463 |
| CD589 PV1-GNCR-L1-RfxCas13d-577C-NLS-BGHpA | 1008 | 1086 | 1164 | 4310 | 6256 |
| CD590 PV1-DNCR-L1-RfxCas13d-150C-NLS-BGHpA | 1009 | 1087 | 1165 | 5032 | 8247 |
| CD591 PV1-DNCR-L1-RfxCas13d-181C-NLS-BGHpA | 1010 | 1088 | 1166 | 4310 | 7432 |
| CD592 PV1-DNCR-L1-RfxCas13d-216C-NLS-BGHpA | 1011 | 1089 | 1167 | 4310 | 7327 |
| CD593 PV1-DNCR-L1-RfxCas13d-264C-NLS-BGHpA | 1012 | 1090 | 1168 | 4310 | 7183 |
| CD594 PV1-DNCR-L1-RfxCas13d-318C-NLS-BGHpA | 1013 | 1091 | 1169 | 5087 | 7798 |
| CD595 PV1-DNCR-L1-RfxCas13d-341C-NLS-BGHpA | 1014 | 1092 | 1170 | 3352 | 5994 |
| CD596 PV1-DNCR-L1-RfxCas13d-405C-NLS-BGHpA | 1015 | 1093 | 1171 | 2929 | 5379 |
| CD597 PV1-DNCR-L1-RfxCas13d-474C-NLS-BGHpA | 1016 | 1094 | 1172 | 5119 | 7362 |
| CD598 PV1-DNCR-L1-RfxCas13d-508C-NLS-BGHpA | 1017 | 1095 | 1173 | 4310 | 6451 |
| CD599 PV1-DNCR-L1-RfxCas13d-577C-NLS-BGHpA | 1018 | 1096 | 1174 | 4310 | 6244 |
| CD674 PV1-RfxCas13d-N88-L1-dNS31a-NLS-BGHpA | 1019 | 1097 | 1175 | 4310 | 5260 |
| CD675 PV1-RfxCas13d-N177-L1-dNS31a-NLS-BGHpA | 1020 | 1098 | 1176 | 4310 | 5527 |
| CD676 PV1-RfxCas13d-N384-L1-dNS31a-NLS-BGHpA | 1021 | 1099 | 1177 | 4310 | 6148 |
| CD677 PV1-RfxCas13d-N559-L1-dNS31a-NLS-BGHpA | 1022 | 1100 | 1178 | 4310 | 6673 |
| CD678 PV1-RfxCas13d-N565-L1-dNS31a-NLS-BGHpA | 1023 | 1101 | 1179 | 4310 | 6691 |
| CD679 PV1-RfxCas13d-N583-L1-dNS31aNLS-BGHpA | 1024 | 1102 | 1180 | 4310 | 6745 |
| CD680 PV1-RfxCas13d-N655-L1-dNS31a-NLS-BGHpA | 1025 | 1103 | 1181 | 4310 | 6961 |
| CD681 PV1-RfxCas13d-N684-L1-dNS31a-NLS-BGHpA | 1026 | 1104 | 1182 | 5893 | 653 |

TABLE 22-continued

Exemplary Reader and Repressible Protease Sequences.

| Plasmid Name and Description | Vec. | Nuc. | Pep. | Start | End |
|---|---|---|---|---|---|
| CD682 PV1-RfxCas13d-N769-L1-dNS31a-NLS-BGHpA | 1027 | 1105 | 1183 | 2210 | 5203 |
| CD683 PV1-RfxCas13d-N903-L1-dNS31a-NLS-BGHpA | 1028 | 1106 | 1184 | 4310 | 7705 |
| CD684 PV1-GNCR-L1-RfxCas13d-89C-NLS-BGHpA | 1029 | 1107 | 1185 | 4310 | 7720 |
| CD685 PV1-GNCR-L1-RfxCas13d-178C-NLS-BGHpA | 1030 | 1108 | 1186 | 4310 | 7453 |
| CD686 PV1-GNCR-L1-RfxCas13d-385C-NLS-BGHpA | 1031 | 1109 | 1187 | 4310 | 6832 |
| CD687 PV1-GNCR-L1-RfxCas13d-560C-NLS-BGHpA | 1032 | 1110 | 1188 | 4310 | 6307 |
| CD688 PV1-GNCR-L1-RfxCas13d-566C-NLS-BGHpA | 1033 | 1111 | 1189 | 4310 | 6289 |
| CD689 PV1-GNCR-L1-RfxCas13d-584C-NLS-BGHpA | 1034 | 1112 | 1190 | 4310 | 6235 |
| CD690 PV1-GNCR-L1-RfxCas13d-656C-NLS-BGHpA | 1035 | 1113 | 1191 | 6947 | 1707 |
| CD691 PV1-GNCR-L1-RfxCas13d-685C-NLS-BGHpA | 1036 | 1114 | 1192 | 4310 | 5932 |
| CD692 PV1-GNCR-L1-RfxCas13d-770C-NLS-BGHpA | 1037 | 1115 | 1193 | 4310 | 5677 |
| CD693 PV1-GNCR-L1-RfxCas13d-904C-NLS-BGHpA | 1038 | 1116 | 1194 | 4310 | 5275 |
| CD694 PV1-DNCR-L1-RfxCas13d-89C-NLS-BGHpA | 1039 | 1117 | 1195 | 4310 | 7708 |
| CD695 PV1-DNCR-L1-RfxCas13d-178C-NLS-BGHpA | 1040 | 1118 | 1196 | 4310 | 7441 |
| CD696 PV1-DNCR-L1-RfxCas13d-385C-NLS-BGHpA | 1041 | 1119 | 1197 | 4310 | 6820 |
| CD697 PV1-DNCR-L1-RfxCas13d-560C-NLS-BGHpA | 1042 | 1120 | 1198 | 4310 | 6295 |
| CD698 PV1-DNCR-L1-RfxCas13d-566C-NLS-BGHpA | 1043 | 1121 | 1199 | 4310 | 6277 |
| CD699 PV1-DNCR-L1-RfxCas13d-584C-NLS-BGHpA | 1044 | 1122 | 1200 | 4310 | 6223 |
| CD700 PV1-DNCR-L1-RfxCas13d-656C-NLS-BGHpA | 1045 | 1123 | 1201 | 6935 | 1695 |
| CD701 PV1-DNCR-L1-RfxCas13d-685C-NLS-BGHpA | 1046 | 1124 | 1202 | 4310 | 5920 |
| CD702 PV1-DNCR-L1-RfxCas13d-770C-NLS-BGHpA | 1047 | 1125 | 1203 | 4310 | 5665 |
| CD703 PV1-DNCR-L1-RfxCas13d-904C-NLS-BGHpA | 1048 | 1126 | 1204 | 4310 | 5263 |
| CD782 PV1-NES-RfxCas13d-N88-L1-NS31a-NES-BGHpA | 1049 | 1127 | 1205 | 5048 | 6025 |
| CD783 PV1-NLS-Lz-DNCR-L1-RfxCas13d-507C-NLS-BGHpA | 1050 | 1128 | 1206 | 5029 | 7218 |
| CD784 PV1-NLS-Lz-GNCR-L1-RfxCas13d-507C-NLS-BGHpA | 1051 | 1129 | 1207 | 4174 | 6375 |
| CD787 PV1-NES-RfxCas13d-N384-L1-NS31a-NES-BGHpA | 1052 | 1130 | 1208 | 4310 | 6175 |
| CD788 PV1-NES-RfxCas13d-N559-L1-NS31a-NES-BGHpA | 1053 | 1131 | 1209 | 4310 | 6700 |
| CD789 PV1-NES-RfxCas13d-N565-L1-NS31a-NES-BGHpA | 1054 | 1132 | 1210 | 4310 | 6718 |
| CD790 PV1-NES-RfxCas13d-N263-L1-NS31a-NES-BGHpA | 1055 | 1133 | 1211 | 4310 | 5812 |
| CD791 PV1-NES-RfxCas13d-N404-L1-NS31a-NES-BGHpA | 1056 | 1134 | 1212 | 5485 | 245 |
| CD792 PV1-NES-RfxCas13d-N507-L1-NS31a-NES-BGHpA | 1057 | 1135 | 1213 | 4310 | 6544 |
| CD793 PV1-NES-RfxCas13d-N579-L1-NS31a-NES-BGHpA | 1058 | 1136 | 1214 | 4310 | 6751 |
| CD794 PV1-NLS-Lz-DNCR-L1-RfxCas13d-89C-NLS-BGHpA | 1059 | 1137 | 1215 | 5029 | 8475 |
| CD795 PV1-NLS-Lz-DNCR-L1-RfxCas13d-385C-NLS-BGHpA | 1060 | 1138 | 1216 | 2153 | 4711 |
| CD796 PV1-NLS-Lz-DNCR-L1-RfxCas13d-560C-NLS-BGHpA | 1061 | 1139 | 1217 | 5029 | 7062 |
| CD797 PV1-NLS-Lz-DNCR-L1-RfxCas13d-566C-NLS-BGHpA | 1062 | 1140 | 1218 | 4310 | 7044 |
| CD798 PV1-NLS-Lz-DNCR-L1-RfxCas13d-264C-NLS-BGHpA | 1063 | 1141 | 1219 | 6467 | 1230 |
| CD799 PV1-NLS-Lz-DNCR-L1-RfxCas13d-405C-NLS-BGHpA | 1064 | 1142 | 1220 | 5029 | 7527 |
| CD800 PV1-NLS-Lz-DNCR-L1-RfxCas13d-577C-NLS-BGHpA | 1065 | 1143 | 1221 | 5029 | 7011 |
| CD801 PV1-NES-RfxCas13d-N88-L1-NS31a-BGHpA | 1066 | 1144 | 1222 | 4310 | 5263 |

TABLE 29

Exemplary CaffVHH Sequences.

| Category | Plasmid Name and Description | Vec. | Nuc. | Pep. | Start | End |
|---|---|---|---|---|---|---|
| single CaffVHH FlpO | CD77 PV1-FlpO-N27-L1-CaffVHH-NLS-BGHpA | 1740 | 1790 | 1840 | 4303 | 4809 |
| | CD78 PV1-CaffVHH-L1-F1pO-28C-NLS-BGHpA | 1741 | 1791 | 1841 | 4310 | 5923 |
| | CD79 PV1-FlpO-N168-L1-CaffVHH-NLS-BGHpA | 1742 | 1792 | 1842 | 4303 | 5232 |
| | CD80 PV1-CaffVHH-L1-FlpO-169C-NLS-BGHpA | 1743 | 1793 | 1843 | 4310 | 5500 |
| | CD81 PV1-FlpO-N374-L1-CaffVHH-NLS-BGHpA | 1744 | 1794 | 1844 | 4303 | 5850 |
| | CD82 PV1-CaffVHH-L1-FlpO-375C-NLS-BGHpA | 1745 | 1795 | 1845 | 4310 | 4882 |
| | CD83 PV1-FlpO-N396-L1-CaffVHH-NLS-BGHpA | 1746 | 1796 | 1846 | 4303 | 5916 |
| | CD84 PV1-CaffVHH-L1-FlpO-397C-NLS-BGHpA | 1747 | 1797 | 1847 | 4310 | 4816 |
| single CaffVHH iCre | CD85 PV1-iCre-N229-L1-CaffVHH-NLS-BGHpA | 1748 | 1798 | 1848 | 4310 | 5422 |
| | CD86 PV1-CaffVHH-L1-iCre-230C-NLS-BGHpA | 1749 | 1799 | 1849 | 4310 | 5077 |
| | CD87 PV1-iCre-N251-L1-CaffVHH-NLS-BGHpA | 1750 | 1800 | 1850 | 581 | 1759 |
| | CD88 PV1-CaffVHH-L1-iCre-252C-NLS-BGHpA | 1751 | 1801 | 1851 | 4310 | 5011 |
| | CD89 PV1-iCre-N256-L1-CaffVHH-NLS-BGHpA | 1752 | 1802 | 1852 | 4310 | 5503 |
| | CD90 PV1-CaffVHH-L1-iCre-257C-NLS-BGHpA | 1753 | 1803 | 1853 | 4310 | 4996 |
| | CD91 PV1-iCre-N270-L1-CaffVHH-NLS-BGHpA | 1754 | 1804 | 1854 | 4310 | 5545 |
| | CD92 PV1-CaffVHH-L1-iCre-271C-NLS-BGHpA | 1755 | 1805 | 1855 | 4310 | 4954 |
| tandem CaffVHH split iCre | CD175 PV1-iCre-N270-L1-tandem CaffVHH-NLS-BGHpA | 1756 | 1806 | 1856 | 4310 | 5908 |
| | CD176 PV1-tandem CaffVHH-L1-iCre-271C-NLS-BGHpA | 1757 | 1807 | 1857 | 2115 | 3122 |
| | CD207 PV1-iCre-N229-L1-tandem CaffVHH-NLS-BGHpA | 1758 | 1808 | 1858 | 4310 | 5422 |
| | CD208 PV1-iCre-N251-L1-tandem CaffVHH-NLS-BGHpA | 1759 | 1809 | 1859 | 4310 | 5851 |
| | CD209 PV1-N256 iCre-tandem CaffVHH-NLS-BGHpA | 1760 | 1810 | 1860 | 4310 | 5866 |
| | CD210 PV1-tandem CaffVHH-L1-iCre-230C-NLS-BGHpA | 1761 | 1811 | 1861 | 2115 | 3245 |

TABLE 29-continued

Exemplary CaffVHH Sequences.

| Category | Plasmid Name and Description | Vec. | Nuc. | Pep. | Start | End |
|---|---|---|---|---|---|---|
| | CD211 PV1-tandem CaffVHH-L1-iCre-252C-NLS-BGHpA | 1762 | 1812 | 1862 | 2115 | 3179 |
| | CD212 PV1-tandem CaffVHH-iCre 257C-NLS-BGHpA | 1763 | 1813 | 1863 | 4310 | 5359 |
| tandem | CD191 PV1-N27 FlpO-tandem CaffVHH | 1764 | 1814 | 1864 | 4303 | 5172 |
| CaffVHH | CD192 PV1-N168 FlpO-tandem CaffVHH | 1765 | 1815 | 1865 | 4303 | 5595 |
| split | CD193 PV1-N374 FlpO-tandem CaffVHH | 1766 | 1816 | 1866 | 4303 | 6213 |
| FlpO | CD194 PV1-N396 FlpO-tandem CaffVHH | 1767 | 1817 | 1867 | 4303 | 6279 |
| | CD195 PV1-tandem CaffVHH-FlpO 28C | 1768 | 1818 | 1868 | 4310 | 6286 |
| | CD196 PV1-tandem CaffVHH-FlpO 169C | 1769 | 1819 | 1869 | 4310 | 5863 |
| | CD197 PV1-tandem CaffVHH-FlpO 375C | 1770 | 1820 | 1870 | 4310 | 5245 |
| | CD198 PV1-tandem CaffVHH-FlpO 397C | 1771 | 1821 | 1871 | 4310 | 1579 |
| tandem | CD199 PV1-N233 PhiC-tandem CaffVHH | 1772 | 1822 | 1872 | 4310 | 5797 |
| CaffVHH | CD200 PV1-N396 PhiC-tandem CaffVHH | 1773 | 1823 | 1873 | 4310 | 6286 |
| split phiC | CD201 PV1-N428 PhiC-tandem CaffVHH | 1774 | 1824 | 1874 | 4310 | 6382 |
| | CD202 PV1-N571 PhiC-tandem CaffVHH | 1775 | 1825 | 1875 | 4310 | 6811 |
| | CD203 PV1-tandem CaffVHH-PhiC 234C | 1776 | 1826 | 1876 | 4310 | 6214 |
| | CD204 PV1-tandem CaffVHH-PhiC 397C | 1777 | 1827 | 1877 | 4310 | 5725 |
| | CD205 PV1-tandem CaffVHH-PhiC 429C | 1778 | 1828 | 1878 | 4310 | 5629 |
| | CD206 PV1-tandem CaffVHH-PhiC 572C | 1779 | 1829 | 1879 | 4310 | 5200 |
| tandem | CD213 PV1-N82 vCre-tandem CaffVHH | 1780 | 1830 | 1880 | 4303 | 5337 |
| CaffVHH | CD214 PV1-N172 vCre-tandem CaffVHH | 1781 | 1831 | 1881 | 4303 | 5607 |
| split vCre | CD215 PV1-N210 vCre-tandem CaffVHH | 1782 | 1832 | 1882 | 4303 | 5721 |
| | CD216 PV1-N269 vCre-tandem CaffVHH | 1783 | 1833 | 1883 | 4303 | 5898 |
| | CD217 PV1-N277 vCre-tandem CaffVHH | 1784 | 1834 | 1884 | 4303 | 5922 |
| | CD218 PV1-tandem CaffVHH-vCre 83C | 1785 | 1835 | 1885 | 4303 | 5985 |
| | CD219 PV1-tandem CaffVHH-vCre 173C | 1786 | 1836 | 1886 | 661 | 2073 |
| | CD220 PV1-tandem CaffVHH-vCre 211C | 1787 | 1837 | 1887 | 2200 | 3498 |
| | CD221 PV1-tandem CaffVHH-vCre 270C | 1788 | 1838 | 1888 | 4303 | 5424 |
| | CD222 PV1-tandem CaffVHH-vCre 278C | 1789 | 1839 | 1889 | 4303 | 5400 |

TABLE 32

Exemplary Cas13a Sequences.

| Plasmid Name and Description | Vec. | Nuc. | Pep. | Start | End |
|---|---|---|---|---|---|
| CD898 PV1-LwCas13a-N397-L1-GID-NLS-BGHpA | 1987 | 2010 | 2033 | 4310 | 6601 |
| CD899 PV1-GAI-L1-LwCas13a-398C-NLS-BGHpA | 1988 | 2011 | 2034 | 5019 | 8399 |
| CD900 PV1-LwCas13a-N416-L1-GID-NLS-BGHpA | 1989 | 2012 | 2035 | 4310 | 6658 |
| CD901 PV1-GAI-L1-LwCas13a-417C-NES-BGHpA | 1990 | 2013 | 2036 | 4758 | 8081 |
| CD902 PV1-LwCas13a-N421-L1-GID-NLS-BGHpA | 1991 | 2014 | 2037 | 3099 | 5462 |
| CD903 PV1-GAI-L1-LwCas13a-422C-NLS-BGHpA | 1992 | 2015 | 2038 | 4310 | 7618 |
| CD904 PV1-LwCas13a-N488-L1-GID-NLS-BGHpA | 1993 | 2016 | 2039 | 4310 | 6874 |
| CD905 PV1-GAI-L1-LwCas13a-489C-NLS-BGHpA | 1994 | 2017 | 2040 | 5032 | 8139 |
| CD906 PV1-LwCas13a-N605-L1-GID-NLS-BGHpA | 1995 | 2018 | 2041 | 225 | 6140 |
| CD907 PV1-GAI-L1-LwCas13a-606C-NLS-BGHpA | 1996 | 2019 | 2042 | 4310 | 7066 |
| CD908 PV1-LwCas13a-N663-L1-GID-NLS-BGHpA | 1997 | 2020 | 2043 | 4806 | 7895 |
| CD909 PV1-GAI-L1-LwCas13a-664C-NLS-BGHpA | 1998 | 2021 | 2044 | 4310 | 6892 |
| CD910 PV1-LwCas13a-N786-L1-GID-NES-BGHpA | 1999 | 2022 | 2045 | 4310 | 7768 |
| CD911 PV1-GAI-L1-LwCas13a-787C-NES-BGHpA | 2000 | 2023 | 2046 | 4310 | 6523 |
| CD912 PV1-LwCas13a-N826-L1-GID-NES-BGHpA | 2001 | 2024 | 2047 | 4310 | 7888 |
| CD913 PV1-GAI-L1-LwCas13a-827C-NLS-BGHpA | 2002 | 2025 | 2048 | 5087 | 7180 |
| CD914 PV1-LwCas13a-N831-L1-GID-NLS-BGHpA | 2003 | 2026 | 2049 | 2202 | 5795 |
| CD915 PV1-GAI-L1-LwCas13a-832C-NLS-BGHpA | 2004 | 2027 | 2050 | 1737 | 3815 |
| CD916 PV1-LwCas13a-N843-L1-GID-NLS-BGHpA | 2005 | 2028 | 2051 | 4310 | 7939 |
| CD917 PV1-GAI-L1-LwCas13a-844C-NLS-BGHpA | 2006 | 2029 | 2052 | 2929 | 4971 |
| CD918 PV1-LwCas13a-N942-L1-GID-NLS-BGHpA | 2007 | 2030 | 2053 | 2202 | 6128 |
| CD919 PV1-GAI-L1-LwCas13a-943C-NLS-BGHpA | 2008 | 2031 | 2054 | 4310 | 6055 |
| CD952 PV1-LwaCas13a-L-msGFP-NLS-BGHpA (WT Cas13a) | 2009 | 2032 | 2055 | 4310 | 8563 |

In some embodiments of any of the aspects, the C-terminal Cas13a polypeptide (e.g., SEQ ID NOs: 2034, 2036, 2038, 2040, 2042, 2044, 2046, 2048, 2050, 2052, or 2054) comprises a C-terminal msGFP domain (see e.g., SEQ ID NO: 2169), e.g., for detection of the polypeptide. In some embodiments of any of the aspects, the C-terminal Cas3a polypeptide does not comprise a C-terminal detectable maker such as msGFP. In some embodiments of any of the aspects, the C-terminal Cas13a polypeptide comprises one of SEQ ID NOs: 2034, 2036, 2038, 2040, 2042, 2044, 2046, 2048, 2050, 2052, or 2054 that lacks a C-terminal msGFP domain (e.g., SEQ ID NO: 2169); the sequence without a C-terminal msGFP can still comprise a C-terminal sequestering domain (e.g., SV40 NLS, SEQ ID NO: 193).

TABLE 33

Exemplary Cas13b Sequences.

| Plasmid Name and Description | SEQ ID NOs Vec. | SEQ ID NOs Nuc. | SEQ ID NOs Pep. | Vector Nuc. Start | Vector Nuc. End | NLS or NES | |
|---|---|---|---|---|---|---|---|
| CD874 PV1-PspCas13b-N31-L1-GID-NES-BGHpA | 2056 | 2093 | 2130 | 4310 | 5506 | NES | FAK |
| CD875 PV1-GAI-L1-PspCas13b-32C-NES-BGHpA | 2057 | 2094 | 2131 | 4310 | 7846 | NES | HIV Rev |
| CD876 PV1-PspCas13b-N49-L1-GID-NES-BGHpA | 2058 | 2095 | 2132 | 2202 | 3452 | NES | FAK |
| CD877 PV1-GAI-L1-PspCas13b-50C-NES-BGHpA | 2059 | 2096 | 2133 | 5032 | 8514 | NES | HIV Rev |
| CD878 PV1-PspCas13b-N1053-L1-GID-NES-BGHpA | 2060 | 2097 | 2134 | 3096 | 7358 | NES | FAK |
| CD879 PV1-GAI-L1-PspCas13b-1054C-NES-BGHpA | 2061 | 2098 | 2135 | 2929 | 3399 | NES | HIV Rev |
| CD880 PV1-PspCas13b-N151-L1-GID-NES-BGHpA | 2062 | 2099 | 2136 | 4310 | 5866 | NES | FAK |
| CD881 PV1-GAI-L1-PspCas13b-152C-NES-BGHpA | 2063 | 2100 | 2137 | 4310 | 7486 | NES | HIV Rev |
| CD882 PV1-PspCas13b-N177-L1-GID-NES-BGHpA | 2064 | 2101 | 2138 | 2202 | 3836 | NES | FAK |
| CD883 PV1-GAI-L1-PspCas13b-178C-NES-BGHpA | 2065 | 2102 | 2139 | 4310 | 7408 | NES | HIV Rev |
| CD884 PV1-PspCas13b-N250-L1-GID-NES-BGHpA | 2066 | 2103 | 2140 | 4806 | 6659 | NES | FAK |
| CD885 PV1-GAI-L1-PspCas13b-251C-NES-BGHpA | 2067 | 2104 | 2141 | 4310 | 7189 | NES | HIV Rev |
| CD886 PV1-PspCas13b-N984-L1-GID-NES-BGHpA | 2068 | 2105 | 2142 | 4310 | 8365 | NES | FAK |
| CD887 PV1-GAI-L1-PspCas13b-985C-NES-BGHpA | 2069 | 2106 | 2143 | 4310 | 4987 | NES | HIV Rev |
| CD888 PV1-PspCas13b-N431-L1-GID-NES-BGHpA | 2070 | 2107 | 2144 | 4310 | 6706 | NES | FAK |
| CD889 PV1-GAI-L1-PspCas13b-432C-NES-BGHpA | 2071 | 2108 | 2145 | 5087 | 7423 | NES | HIV Rev |
| CD890 PV1-PspCas13b-N435-L1-GID-NES-BGHpA | 2072 | 2109 | 2146 | 4310 | 6718 | NES | FAK |
| CD891 PV1-GAI-L1-PspCas13b-436C-NES-BGHpA | 2073 | 2110 | 2147 | 2929 | 5253 | NES | HIV Rev |
| CD892 PV1-PspCas13b-N441-L1-GID-NES-BGHpA | 2074 | 2111 | 2148 | 225 | 2651 | NES | FAK |
| CD893 PV1-GAI-L1-PspCas13b-442C-NES-BGHpA | 2075 | 2112 | 2149 | 4310 | 6616 | NES | HIV Rev |
| CD894 PV1-PspCas13b-N954-L1-GID-NES-BGHpA | 2076 | 2113 | 2150 | 4310 | 8275 | NES | FAK |
| CD895 PV1-GAI-L1-PspCas13b-955C-NES-BGHpA | 2077 | 2114 | 2151 | 4758 | 5525 | NES | HIV Rev |
| CD896 PV1-PspCas13b-N1065-L1-GID-NES-BGHpA | 2078 | 2115 | 2152 | 3099 | 7397 | NES | FAK |
| CD897 PV1-GAI-L1-PspCas13b-1066C-NES-BGHpA | 2079 | 2116 | 2153 | 2929 | 3363 | NES | HIV Rev |
| CD920 PV1-PspCas13b-N31-L1-GID-NLS-BGHpA | 2080 | 2117 | 2154 | 4310 | 5503 | NLS | SV40 |
| CD922 PV1-PspCas13b-N49-L1-GID-NLS-BGHpA | 2081 | 2118 | 2155 | 2202 | 3449 | NLS | SV40 |
| CD924 PV1-PspCas13b-N1053-L1-GID-NLS-BGHpA | 2082 | 2119 | 2156 | 3096 | 7355 | NLS | SV40 |
| CD926 PV1-PspCas13b-N151-L1-GID-NLS-BGHpA | 2083 | 2120 | 2157 | 4310 | 5863 | NLS | SV40 |
| CD928 PV1-PspCas13b-N177-L1-GID-NLS-BGHpA | 2084 | 2121 | 2158 | 2202 | 3833 | NLS | SV40 |
| CD930 PV1-PspCas13b-N250-L1-GID-NLS-BGHpA | 2085 | 2122 | 2159 | 4806 | 6656 | NLS | SV40 |
| CD932 PV1-PspCas13b-N984-L1-GID-NLS-BGHpA | 2086 | 2123 | 2160 | 4310 | 8362 | NLS | SV40 |
| CD934 PV1-PspCas13b-N431-L1-GID-NLS-BGHpA | 2087 | 2124 | 2161 | 4310 | 6703 | NLS | SV40 |
| CD936 PV1-PspCas13b-N435-L1-GID-NLS-BGHpA | 2088 | 2125 | 2162 | 4310 | 6715 | NLS | SV40 |
| CD938 PV1-PspCas13b-N441-L1-GID-NLS-BGHpA | 2089 | 2126 | 2163 | 225 | 2648 | NLS | SV40 |
| CD940 PV1-PspCas13b-N954-L1-GID-NLS-BGHpA | 2090 | 2127 | 2164 | 4310 | 8272 | NLS | SV40 |
| CD942 PV1-PspCas13b-N1065-L1-GID-NLS-BGHpA | 2091 | 2128 | 2165 | 3099 | 7394 | NLS | SV40 |
| CD951 PV1-PspCas13b-HIV NES-BGHpA (WT Cas13b) | 2092 | 2129 | 2166 | 4310 | 7621 | NES | HIV Rev |

Each polypeptide comprises an NLS or NES on the c terminus, as indicated. "FAK" indicates focal adhesion kinase NES (LDLASLIL, SEQ ID NO: 2168); "HIV Rev" indicates HIV-1 Rev NES (LPPLERLTL, SEQ ID NO: 192); "SV40" indicates simian virus 40 (SV40) NLS (PKKKRKV, SEQ ID NO: 193).

In some embodiments of any of the aspects, a first polypeptide (e.g., N-terminal Cas13b fragment; or vector or polynucleotide encoding the polypeptide) comprising an NLS can be selected from Table 33 in place of a first polypeptide (or vector or polynucleotide encoding the polypeptide) comprising the same N-terminal Cas13b polypeptide fragment and an NES selected from Table 33. As a non-limiting example, SEQ ID NOs: 2154, 2155, 2156, 2157, 2158, 2159, 2160, 2161, 2162, 2163, 2164, or 2165 can be selected in place of SEQ ID NOs: 2130, 2132, 2134, 2136, 2138, 2140, 2142, 2144, 2146, 2148, 2150, or 2152, respectively, or vice versa.

In some embodiments of any of the aspects, an inducible polypeptide system comprises a first polypeptide selected from one of Tables 18-22, 29, 32-33 and a second polypeptide selected from the same table (e.g., one of Tables 18-22, 29, 32-33). In some embodiments of any of the aspects, the first polypeptide comprises an N-terminal fragment of Cas13 (e.g., Cas13d, Cas13a, or Cas13b) and a first member of an inducible dimerization domain; the second polypeptide in the same system comprises the C-terminal fragment of Cas13 that complements the N-terminal fragment (e.g., N88 and 89C) and a second member of the same inducible dimerization domain (e.g., ABI and PYL).

In some embodiments of any of the aspects, the polypeptide comprises one of SEQ ID NOs: 337-394, 515-574, 735-814, 931-988, 1145-1222, 1840-1889, 2033-2054, 2130-2165 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 337-394, 515-574, 735-814, 931-988, 1145-1222, 1840-1889, 2033-2054, or 2130-2165 that maintains the same function.

In some embodiments of any of the aspects, the polypeptide is selected from a group of embodiments that showed the highest performance in the tested conditions, including: SEQ ID NOs: 391, 392, 769, 770, 792, 793, 796, 797, 800, 801, 804, 805, 809, 810, 813, 814, 1206, and/or 1209.

In several aspects described herein are repressible polypeptides and repressible polypeptide systems. In one aspect described herein is A repressible split-nuclease polypeptide system comprising: (a) a first polypeptide comprising: (i) a first member of a repressible dimerization domain (RD$^1$); and (ii) a first polypeptide fragment of a sequence-specific nuclease (N$^1$); and (b) a second polypeptide comprising: (i) a second member of the repressible dimerization domain (RD$^2$); and (ii) a second polypeptide fragment of the sequence-specific nuclease (N$^2$). In some embodiments of any of the aspects, the first and second members of the repressible dimerization domain come together in the absence of a repressor agent or repressor signal, resulting in protein complementation of the two nuclease polypeptide fragments to form the active nuclease protein in the absence of the repressor agent or repressor signal. In some embodiments of any of the aspects, the first and second members of the repressible dimerization domain do not come together in the presence of the repressor agent or repressor signal, resulting in no protein complementation of the two nuclease polypeptide fragments and no formation of the active nuclease protein in the presence of the repressor agent or repressor signal.

In one aspect, described herein is a first polypeptide comprising: (i) a first member of a repressible dimerization domain ($RD^1$); and (ii) a first polypeptide fragment of a sequence-specific nuclease ($N^1$). In some embodiments of any of the aspects, $RD^1$ is N-terminal to $N^1$. In some embodiments of any of the aspects, $RD^1$ is C-terminal to $N^1$. In one aspect, described herein is a second polypeptide comprising: (i) a second member of a repressible dimerization domain ($RD^2$); and (ii) a second polypeptide fragment of a sequence-specific nuclease ($N^2$). In some embodiments of any of the aspects, $RD^2$ is N-terminal to $N^2$. In some embodiments of any of the aspects, $RD^2$ is C-terminal to $N^2$.

In one aspect described herein is a repressible split-recombinase polypeptide system comprising: (a) a first polypeptide comprising: (i) a first member of a repressible dimerization domain ($RD^1$); and (ii) a first polypeptide fragment of a recombinase ($R^1$); and (b) a second polypeptide comprising: (i) a second member of the repressible dimerization domain ($RD^2$); and (ii) a second polypeptide fragment of the recombinase ($R^2$). In some embodiments of any of the aspects, the first and second members of the repressible dimerization domain come together in the absence of a repressor agent or repressor signal, resulting in protein complementation of the two recombinase polypeptide fragments to form the active recombinase protein in the absence of the repressor agent or repressor signal. In some embodiments of any of the aspects, the first and second members of the repressible dimerization domain do not come together in the presence of the repressor agent or repressor signal, resulting in no protein complementation of the two recombinase polypeptide fragments and no formation of the active recombinase protein in the presence of the repressor agent or repressor signal.

In one aspect, described herein is a first polypeptide comprising: (i) a first member of a repressible dimerization domain ($RD^1$); and (ii) a first polypeptide fragment of a recombinase ($R^1$). In some embodiments of any of the aspects, $RD^1$ is N-terminal to $R^1$. In some embodiments of any of the aspects, $RD^1$ is C-terminal to $R^1$. In one aspect, described herein is a second polypeptide comprising: (i) a second member of a repressible dimerization domain ($RD^2$); and (ii) a second polypeptide fragment of a recombinase ($R^2$). In some embodiments of any of the aspects, $RD^2$ is N-terminal to $R^2$. In some embodiments of any of the aspects, $RD^2$ is C-terminal to $R^2$.

In one aspect described herein is a repressible dimerization system comprising: (a) a first polypeptide comprising from N-terminal to C-terminal: (i) a first polypeptide fragment (e.g., $N^1$, $R^1$; and (ii) a first member of a repressible dimerization domain ($RD^1$); and (b) a second polypeptide comprising from N-terminal to C-terminal: (i) a second member of the repressible dimerization domain ($RD^2$); and (ii) a second polypeptide fragment (e.g., $N^2$, $R^2$).

In one aspect described herein is a repressible dimerization system comprising: (a) a first polypeptide comprising from N-terminal to C-terminal: (i) a first member of a repressible dimerization domain ($RD^1$); and (ii) a first polypeptide fragment (e.g., $N^1$, $R^1$; and (b) a second polypeptide comprising from N-terminal to C-terminal: (i) a second polypeptide fragment (e.g., $N^2$, $R^2$); and (ii) a second member of the repressible dimerization domain ($RD^2$).

In some embodiments of any of the aspects, $RD^1$ comprises a repressible protease and $RD^2$ comprises a peptide domain. In some embodiments of any of the aspects, $RD^2$ comprises a repressible protease and $RD^1$ comprises a peptide domain. In some embodiments of any of the aspects, the repressible protease specifically binds to the peptide domain in the absence of a specific protease inhibitor. In some embodiments of any of the aspects, the repressible protease does not specifically bind to the peptide domain in the presence of a specific protease inhibitor.

In some embodiments of any of the aspects, the repressible protease is hepatitis C virus (HCV) nonstructural protein 3 (NS3). In some embodiments of any of the aspects, the NS3 is catalytically dead. In some embodiments of any of the aspects, the repressible system polypeptide does not comprise any protease cleavage sites.

In some embodiments of any of the aspects, the repressible system polypeptide further comprises a cofactor for the repressible protease. In some embodiments of any of the aspects, the cofactor is an HSV NS4A domain. In some embodiments of any of the aspects, the HSV NS4A domain is adjacent and N-terminal to the repressible protease.

In some embodiments of any of the aspects, the peptide domain comprises ANR peptide (SEQ ID NO: 170) or CP5-46-5D5E peptide (SEQ ID NO: 171).

In some embodiments of any of the aspects, the protease inhibitor is selected from grazoprevir, danoprevir, simeprevir, asunaprevir, ciluprevir, boceprevir, sovaprevir, paritaprevir, ombitasvir, parntaprevir, ritonavir, dasabuvir, and telaprevir. In some embodiments of any of the aspects, the protease inhibitor is danoprevir or grazoprevir.

Non-limiting examples of inducible polypeptide systems vectors, polynucleotides, or polypeptides are provided below in Table 23. In Table 23, "Vec." indicates vector. "Nuc." indicates polynucleotide. "Pep." indicates polynucleotide. "Vector Nuc" indicates the start and stop nucleotides of the polypeptide in the vector.

TABLE 23

Exemplary Peptide-NS3 Sequences.

| Plasmid Name and Description | SEQ ID NOs | | | Vector Nuc. | |
|---|---|---|---|---|---|
| | Vec. | Nuc. | Pep. | Start | End |
| CD630 PV1-RfxCas13d-N149-L1-dNS31b-NLS-BGHpA | 1223 | 1263 | 1303 | 4310 | 5410 |
| CD631 PV1-RfxCas13d-N180-L1-dNS31b-NLS-BGHpA | 1224 | 1264 | 1304 | 4310 | 5503 |

TABLE 23-continued

Exemplary Peptide-NS3 Sequences.

| | SEQ ID NOs | | | Vector Nuc. | |
|---|---|---|---|---|---|
| Plasmid Name and Description | Vec. | Nuc. | Pep. | Start | End |
| CD632 PV1-RfxCas13d-N215-L1-dNS31b-NLS-BGHpA | 1225 | 1265 | 1305 | 2668 | 3966 |
| CD633 PV1-RfxCas13d-N263-L1-dNS31b-NLS-BGHpA | 1226 | 1266 | 1306 | 4310 | 5752 |
| CD634 PV1-RfxCas13d-N317-L1-dNS31b-NILS-BGHpA | 1227 | 1267 | 1307 | 4310 | 5914 |
| CD635 PV1-RfxCas13d-N340-L1-dNS31b-NLS-BGHpA | 1228 | 1268 | 1308 | 2441 | 4114 |
| CD636 PV1-RfxCas13d-N404-L1-dNS31b-NLS-BGHpA | 1229 | 1269 | 1309 | 4310 | 6175 |
| CD637 PV1-RfxCas13d-N473-L1-dNS31b-NLS-BGHpA | 1230 | 1270 | 1310 | 4951 | 7023 |
| CD638 PV1-RfxCas13d-N507-L1-dNS31b-NLS-BGHpA | 1231 | 1271 | 1311 | 3555 | 5729 |
| CD639 PV1-RfxCas13d-N576L1-dNS31b-NLS-BGHpA | 1232 | 1272 | 1312 | 4310 | 6691 |
| CD640 PV1-peptide-L1-RfxCas13d-150C-NLS-BGHpA | 1233 | 1273 | 1313 | 5032 | 7659 |
| CD641 PV1-peptide-L1-RfxCas13d-181C-NLS-BGHpA | 1234 | 1274 | 1314 | 4310 | 6844 |
| CD642 PV1-peptide-L1-RfxCas13d-216C-NLS-BGHpA | 1235 | 1275 | 1315 | 4310 | 6739 |
| CD643 PV1-peptide-L1-RfxCas13d-264C-NLS-BGHpA | 1236 | 1276 | 1316 | 4310 | 6595 |
| CD644 PV1-peptide-L1-RfxCas13d-318C-NLS-BGHpA | 1237 | 1277 | 1317 | 5087 | 7210 |
| CD645 PV1-peptide-L1-RfxCas13d-341C-NLS-BGHpA | 1238 | 1278 | 1318 | 3352 | 5406 |
| CD646 PV1-peptide-L1-RfxCas13d-405C-NLS-BGHpA | 1239 | 1279 | 1319 | 2929 | 4791 |
| CD647 PV1-peptide-L1-RfxCas13d-474C-NLS-BGHpA | 1240 | 1280 | 1320 | 5119 | 6774 |
| CD648 PV1-peptide-L1-RfxCas13d-508C-NLS-BGHpA | 1241 | 1281 | 1321 | 4310 | 5863 |
| CD649 PV1-peptide-L1-RfxCas13d-577C-NLS-BGHpA | 1242 | 1282 | 1322 | 4310 | 5656 |
| CD704 PV1-RfxCas13d-N88-L1-dNS31b-NLS-BGHpA | 1243 | 1283 | 1323 | 4310 | 5227 |
| CD705 PV1-RfxCas13d-N177-L1-dNS31b-NLS-BGHpA | 1244 | 1284 | 1324 | 4310 | 5494 |
| CD706 PV1-RfxCas13d-N384-L1-dNS31b-NLS-BGHpA | 1245 | 1285 | 1325 | 4310 | 6115 |
| CD707 PV1-RfxCas13d-N559-L1-dNS31b-NLS-BGHpA | 1246 | 1286 | 1326 | 4310 | 6640 |
| CD708 PV1-RfxCas13d-N565-L1-dNS31b-NLS-BGHpA | 1247 | 1287 | 1327 | 4310 | 6658 |
| CD709 PV1-RfxCas13d-N583-L1-dNS31b-NLS-BGHpA | 1248 | 1288 | 1328 | 4310 | 6712 |
| CD710 PV1-RfxCas13d-N655-L1-dNS31b-NLS-BGHpA | 1249 | 1289 | 1329 | 4310 | 6928 |
| CD711 PV1-RfxCas13d-N684-L1-dNS31b-NLS-BGHpA | 1250 | 1290 | 1330 | 5860 | 620 |
| CD712 PV1-RfxCas13d-N769-L1-dNS31b-NLS-BGHpA | 1251 | 1291 | 1331 | 2210 | 5170 |
| CD713 PV1-RfxCas13d-N903-L1-dNS31b-NLS-BGHpA | 1252 | 1292 | 1332 | 4310 | 7672 |
| CD714 PV1-peptide-L1-RfxCas13d-89C-NLS-BGHpA | 1253 | 1293 | 1333 | 4310 | 7120 |
| CD715 PV1-peptide-L1-RfxCas13d-178C-NLS-BGHpA | 1254 | 1294 | 1334 | 4310 | 6853 |
| CD716 PV1-peptide-L1-RfxCas13d-385C-NLS-BGHpA | 1255 | 1295 | 1335 | 4310 | 6232 |
| CD717 PV1-peptide-L1-RfxCas13d-560C-NLS-BGHpA | 1256 | 1296 | 1336 | 4310 | 5707 |
| CD718 PV1-peptide-L1-RfxCas13d-566C-NLS-BGHpA | 1257 | 1297 | 1337 | 4310 | 5689 |
| CD719 PV1-peptide-L1-RfxCas13d-584C-NLS-BGHpA | 1258 | 1298 | 1338 | 4310 | 5635 |
| CD720 PV1-peptide-L1-RfxCas13d-656C-NLS-BGHpA | 1259 | 1299 | 1339 | 1 | 1110 |
| CD721 PV1-peptide-L1-RfxCas13d-685C-NLS-BGHpA | 1260 | 1300 | 1340 | 4310 | 5332 |
| CD722 PV1-peptide-L1-RfxCas13d-770C-NLS-BGHpA | 1261 | 1301 | 1341 | 4310 | 5077 |
| CD723 PV1-peptide-L1-RfxCas13d-904C-NLS-BGHpA | 1262 | 1302 | 1342 | 4309 | 4674 |

In some embodiments of any of the aspects, a repressible polypeptide system comprises a first polypeptide and a second polypeptide selected from Table 23. In some embodiments of any of the aspects, the first polypeptide comprises an N-terminal fragment of Cas13d and a first member of a repressible dimerization domain; the second polypeptide in the same system comprises the C-terminal fragment of Cas13d that complements the N-terminal fragment (e.g., N88 and 89C) and a second member of the same repressible dimerization domain (e.g., peptide and NS3 1b).

In some embodiments of any of the aspects, the polypeptide comprises one of SEQ ID NOs: 1303-1342 or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 1303-1342, that maintains the same function.

Figure 25:
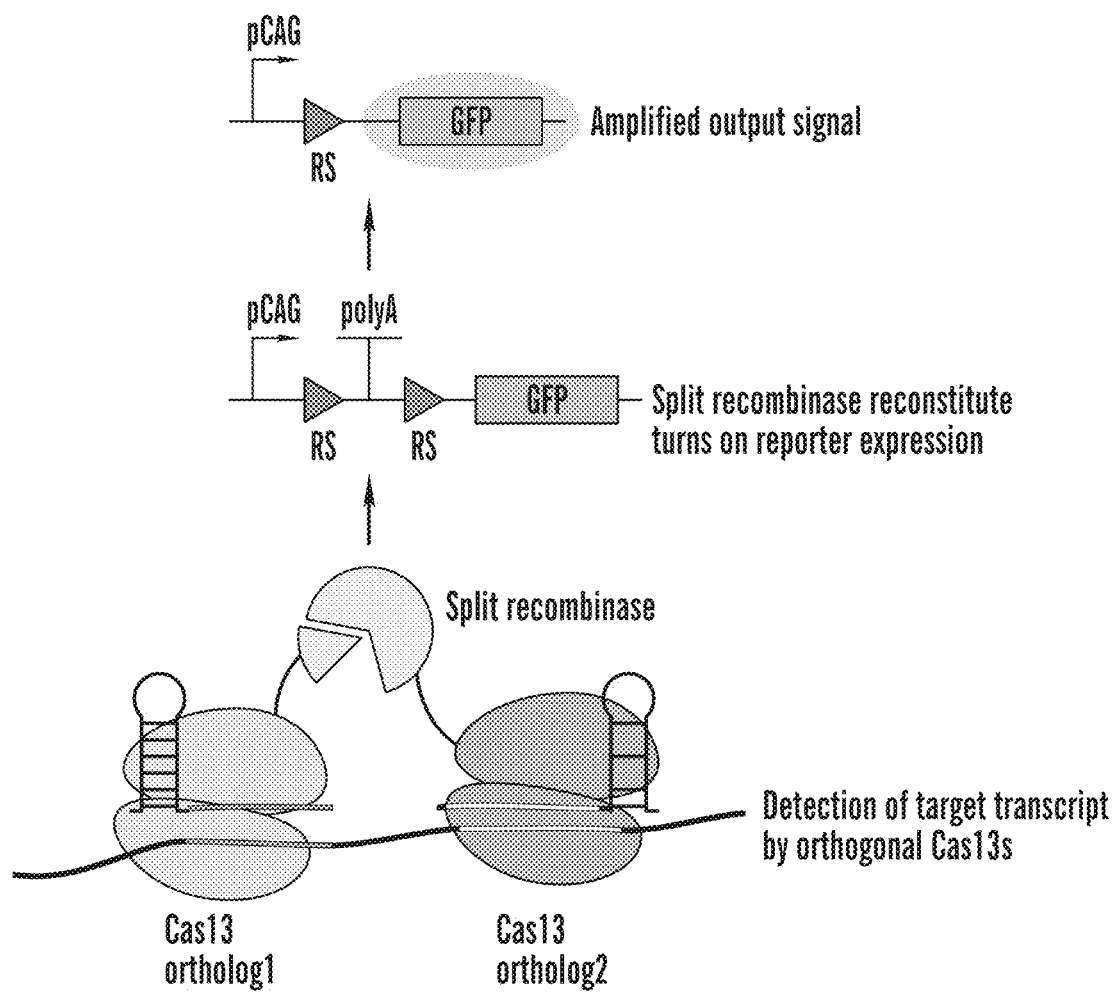
FIG. 25 Is a schematic showing the use of orthogonal Cas13 for the detection of RNA expression and for the recruitment of split recombinases for recombination as a way of signal amplification.

In multiple aspects described herein are inducible nuclease split-recombinase polypeptides and systems thereof (see e.g., FIG. 25). In one aspect, described herein is an inducible nuclease split-recombinase polypeptide system comprising: (a) a first polypeptide comprising: (i) a first sequence-specific nuclease ($N^A$); and (ii) a first polypeptide fragment of a recombinase ($R^1$); and (b) a second polypeptide comprising: (i) a second sequence-specific nuclease ($N^B$); and (ii) a second polypeptide fragment of the recombinase ($R^2$).

In some embodiments of any of the aspects, the first and second sequence-specific nucleases each specifically bind to first and second target nucleic acids in the presence of first and second guide nucleic acids. In some embodiments of any of the aspects, the first and second target nucleic acids are in close proximity to each other, resulting in protein complementation of the two recombinase polypeptide fragments to form the active recombinase protein in the presence of the guide nucleic acids and first and second target nucleic acids.

In one aspect, described herein is a first polypeptide comprising: (i) a first sequence-specific nuclease ($N^A$); and (ii) a first polypeptide fragment of a recombinase ($R^1$). In some embodiments of any of the aspects, $N^A$ is N-terminal to $R^1$. In some embodiments of any of the aspects, $N^A$ is C-terminal to $R^1$. In one aspect, described herein is a second polypeptide comprising: (i) a second sequence-specific nuclease ($N^B$); and (ii) a second polypeptide fragment of a recombinase ($R^2$). In some embodiments of any of the aspects, $N^B$ is N-terminal to $R^2$. In some embodiments of any of the aspects, $N^B$ is C-terminal to $R^2$.

In one aspect described herein is an inducible nuclease split-recombinase system comprising: (a) a first polypeptide comprising from N-terminal to C-terminal: (i) a first polypeptide fragment of a recombinase ($R^1$); and (ii) a first sequence-specific nuclease ($N^A$); and (b) a second polypeptide comprising from N-terminal to C-terminal: (i) a second sequence-specific nuclease ($N^B$); and (ii) a second polypeptide fragment of the recombinase ($R^2$).

In one aspect described herein is an inducible nuclease split-recombinase system comprising: (a) a first polypeptide comprising from N-terminal to C-terminal: (i) a first sequence-specific nuclease ($N^A$); and (ii) a first polypeptide fragment of a recombinase ($R^1$); and (b) a second polypeptide comprising from N-terminal to C-terminal: (i) a second polypeptide fragment of the recombinase ($R^2$); and (ii) a second sequence-specific nuclease ($N^B$).

In some embodiments of any of the aspects, $N^A$ and $N^B$ are comprised by different sequence-specific nucleases that each recognize their guide nucleic acid orthogonally. In a system when a first sequence-specific nuclease is orthogonal to the second sequence-specific nuclease, it means that the second sequence-specific nuclease does not recognize the type of guide nucleic acid specific for the first sequence-specific nuclease, neither does the first sequence-specific nuclease recognize the type of guide nucleic acid specific for the second sequence-specific nuclease. As a non-limiting example, the first and second sequence-specific nucleases recognize guide nucleic acids with different protospacer-adjacent motifs (PAM) or length requirements for the guide nucleic acid. In some embodiments of any of the aspects, $N^A$ and $N^B$ are selected according to Table 31.

polypeptide fragments of the sequence specific nuclease come together in the presence of a guide nucleic acid and a nucleic acid targeted by the guide nucleic acid, resulting in protein complementation of the two recombinase polypeptide fragments to form the active recombinase protein in the presence of the guide nucleic acid and a target nucleic acid targeted by the guide nucleic acid.

In one aspect described herein is a first polypeptide comprising: (i) a first polypeptide fragment of a sequence-specific nuclease ($N^1$); and (ii) a first polypeptide fragment of a recombinase ($R^1$). In some embodiments of any of the aspects, $N^1$ is N-terminal to $R^1$. In some embodiments of any of the aspects, N is C-terminal to $R^1$. In one aspect described herein is a second polypeptide comprising: (i) a second polypeptide fragment of a sequence-specific nuclease ($N^2$); and (ii) a second polypeptide fragment of a recombinase ($R^2$). In some embodiments of any of the aspects, $N^2$ is N-terminal to $R^2$. In some embodiments of any of the aspects, $N^2$ is C-terminal to $R^2$.

In multiple aspects described herein are polypeptides comprising sequestering domains and systems thereof. Any polypeptide or system described herein (e.g., inducible dimerization polypeptides and systems thereof; repressible dimerization polypeptides and systems thereof; inducible nuclease split-recombinase polypeptides and systems

TABLE 31

Exemplary $N^A$ and $N^B$ Pairings (non-orthogonal pairs are indicated by bolded italicized text)

| $N^A$ | Cas13a | *Cas13a* | *Cas13a* | *Cas13b* | Cas13b | *Cas13b* | *Cas13d* | *Cas13d* | Cas13d |
| $N^B$ | Cas13a | *Cas13b* | *Cas13d* | *Cas13a* | Cas13b | *Cas13d* | *Cas13a* | *Cas13b* | Cas13d |

In some embodiments of any of the aspects, the first and second target nucleic acids are comprised by the same nucleic acid molecule. In some embodiments of any of the aspects, the first and second target nucleic acids are within 300 nucleotides of each other. In some embodiments of any of the aspects, the first and second target nucleic acids are comprised by the same nucleic acid molecule, and the system is used to detect the presence and/or expression levels of this nucleic acid molecule (see e.g., FIG. 25).

In some embodiments of any of the aspects, the first and second target nucleic acids are within at most 5, at most 10, at most 20, at most 30, at most 40, at most 50, at most 60, at most 70, at most 80, at most 90, at most 100, at most 150, at most 200, at most 250, at most 300, at most 350, at most 400, at most 450, at most 500, at most 600, at most 700, at most 800, at most 900, at most 1000 or more nucleotides of each other on the same nucleic acid molecule. In some embodiments of any of the aspects, the first and second target nucleic acids are within at least 5, at least 10, at least 20, at least 30, at least 40, at least 50, at least 60, at least 70, at least 80, at least 90, at least 100, at least 150, at least 200, at least 250, at least 300, at least 350, at least 400, at least 450, at least 500, at least 600, at least 700, at least 800, at least 900, at least 1000 or more nucleotides of each other on the same nucleic acid molecule.

In one aspect described herein is an inducible split-nuclease split-recombinase polypeptide system comprising: (a) a first polypeptide comprising: (i) a first polypeptide fragment of a sequence-specific nuclease ($N^1$); and (ii) a first polypeptide fragment of a recombinase ($R^1$); and (b) a second polypeptide comprising: (i) a second polypeptide fragment of the sequence-specific nuclease ($N^2$); and (ii) a second polypeptide fragment of the recombinase ($R^2$). In some embodiments of any of the aspects, the first and second thereof) can further comprise at least one sequestering domain to add a second dimension of control to the system (e.g., an AND-Gate). In some embodiments of any of the aspects, the first control for such an AND-gate system is the inducer agent or signal, the repressor agent or signal, or a guide nucleic acid(s) and target nucleic acid(s) specific to the system. In some embodiments of any of the aspects, the second control for such an AND-gate system is the ligand for the sequestering domain.

In additional aspects, described herein are polypeptides and systems that comprise at least one sequestering domain and do not comprise any inducible or repressible dimerization domains. In one aspect, described herein is an inducible split-nuclease sequestering polypeptide system comprising: a first polypeptide comprising a first polypeptide fragment of a sequence-specific nuclease ($N^1$); and a second polypeptide comprising a second polypeptide fragment of a sequence-specific nuclease ($N^2$), wherein the first and/or second polypeptide comprises a cytosolic sequestering domain. In some embodiments of any of the aspects, the cytosolic sequestering domain comprises a ligand binding domain (LBD). In one aspect, described herein is a first polypeptide comprising a first polypeptide fragment of a sequence-specific nuclease ($N^1$), wherein the first polypeptide comprises a cytosolic sequestering domain. In one aspect, described herein is a second polypeptide comprising a second polypeptide fragment of a sequence-specific nuclease ($N^2$), wherein the second polypeptide comprises a cytosolic sequestering domain. In some embodiments of any of the aspects, the first and/or second polypeptides are transported to the nucleus in the presence of the ligand, resulting in protein complementation of the two nuclease polypeptide fragments to form the active nuclease protein in the presence of the ligand.

In one aspect, described herein is an inducible split-recombinase sequestering polypeptide system comprising: (a) a first polypeptide comprising a first polypeptide fragment of a recombinase ($R^1$); and (b) a second polypeptide comprising a second polypeptide fragment of the recombinase ($R^2$), wherein the first and/or second polypeptide comprises a cytosolic sequestering domain. In some embodiments of any of the aspects, the cytosolic sequestering domain comprises a ligand binding domain (LBD). In one aspect, described herein is a first polypeptide comprising a first polypeptide fragment of a recombinase ($R^1$), wherein the first polypeptide comprises a cytosolic sequestering domain. In one aspect, described herein is a first polypeptide comprising a second polypeptide fragment of a recombinase ($R^2$) wherein the second polypeptide comprises a cytosolic sequestering domain. In some embodiments of any of the aspects, the first and/or second polypeptides are transported to the nucleus in the presence of the ligand, resulting in protein complementation of the two recombinase polypeptide fragments to form the active recombinase protein in the presence of the ligand.

In one aspect, described herein is an inducible recombinase sequestering polypeptide comprising: (a) a sequence-specific nuclease; and (b) at least one cytosolic sequestering domain. In one aspect, described herein is an inducible recombinase sequestering polypeptide comprising: (a) a sequence-specific nuclease; and (b) at least two cytosolic sequestering domains. In one aspect, described herein is an inducible recombinase sequestering polypeptide comprising, form N terminus to C terminus: (a) first cytosolic sequestering domain; (b) a sequence-specific nuclease; and (c) a second cytosolic sequestering domain.

In some embodiments of any of the aspects, the sequestering domain (e.g., ERT, SynNotch) is at the N-terminus of the polypeptide. In some embodiments of any of the aspects, the sequestering domain (e.g., ERT, SynNotch, NES, NLS) is at the C-terminus of the polypeptide. In some embodiments of any of the aspects, the sequestering domain (e.g., ERT, SynNotch, NES, NLS) is at an internal position of the polypeptide. Exemplary configurations of the polypeptides are provided in Tables 24, 25, and 30.

In some embodiments of any of the aspects, the first and/or second polypeptide comprises a cytosolic sequestering domain comprising a ligand binding domain (LBD). In some embodiments of any of the aspects, the first and/or second polypeptide comprises at least one ERT domain (e.g., ERT2). In some embodiments of any of the aspects, the first and/or second polypeptide comprises two ERT domains (e.g., ERT2). In some embodiments of any of the aspects, the first polypeptide comprises at least one cytosolic sequestering domain. In some embodiments of any of the aspects, the second polypeptide comprises at least one cytosolic sequestering domain. In some embodiments of any of the aspects, the first and second polypeptides each comprise at least one cytosolic sequestering domain. In some embodiments of any of the aspects, in the presence of a ligand, the sequestering of the protein to the cytosol is inhibited.

In multiple aspects described herein are polypeptides comprising NES and NLS domains and systems thereof. Any polypeptide or system described herein (e.g., inducible dimerization polypeptides and systems thereof; repressible dimerization polypeptides and systems thereof; inducible nuclease split-recombinase polypeptides and systems thereof) can further comprise at least one NES and/or NLS domain.

In one aspect, described herein is an inducible nuclear split-nuclease polypeptide system comprising (a) a first polypeptide comprising: (i) a first polypeptide fragment of a sequence-specific nuclease ($N^1$); and (ii) a nuclear localization signal (NLS); and (b) a second polypeptide comprising: (i) a second polypeptide fragment of the sequence-specific nuclease ($N^2$); and (ii) a nuclear localization signal (NLS). In some embodiments of any of the aspects, the first and second polypeptides come together in the nucleus in the presence of a guide nucleic acid, resulting in protein complementation of the two nuclease polypeptide fragments to form the active nuclease protein in the presence of the guide nucleic acid.

In one aspect, described herein is a first polypeptide comprising: (i) a first polypeptide fragment of a sequence-specific nuclease ($N^1$) and (ii) a nuclear localization signal (NLS). In some embodiments of any of the aspects, $N^1$ is N terminal of the NLS. In some embodiments of any of the aspects, $N^1$ is C terminal of the NLS. In one aspect, described herein is a second polypeptide comprising: (i) a second polypeptide fragment of a sequence-specific nuclease ($N^1$) and (ii) a nuclear localization signal (NLS). In some embodiments of any of the aspects, $N^1$ is N terminal of the NLS. In some embodiments of any of the aspects, $N^1$ is C terminal of the NLS.

In one aspect, described herein is an inducible cytoplasmic split-nuclease polypeptide system comprising: (a) a first polypeptide comprising: (i) a first polypeptide fragment of a sequence-specific nuclease ($N^1$); and (ii) a nuclear export signal (NES); and (b) a second polypeptide comprising: (i) a second polypeptide fragment of the sequence-specific nuclease ($N^2$); and (ii) a nuclear export signal (NES). In some embodiments of any of the aspects, the first and second polypeptides come together in the cytoplasm in the presence of a guide nucleic acid, resulting in protein complementation of the two nuclease polypeptide fragments to form the active nuclease protein in the presence of the guide nucleic acid.

In one aspect, described herein is a first polypeptide comprising: (i) a first polypeptide fragment of a sequence-specific nuclease ($N^1$) and (ii) a nuclear export signal (NES). In some embodiments of any of the aspects, $N^1$ is N terminal of the NES. In some embodiments of any of the aspects, $N^1$ is C terminal of the NES. In one aspect, described herein is a second polypeptide comprising: (i) a second polypeptide fragment of a sequence-specific nuclease ($N^1$) and (ii) a nuclear export signal (NES). In some embodiments of any of the aspects, $N^1$ is N terminal of the NES. In some embodiments of any of the aspects, $N^1$ is C terminal of the NES.

In one aspect, described herein is an inducible nuclear split-nuclease polypeptide system comprising (a) a first polypeptide comprising: (i) a first polypeptide fragment of a sequence-specific nuclease ($N^1$); and (ii) a nuclear localization signal (NLS); and (b) a second polypeptide comprising: (i) a second polypeptide fragment of the sequence-specific nuclease ($N^2$); and (ii) a nuclear export signal (NES). In some embodiments of any of the aspects, the first and second polypeptides come together in the presence of a guide nucleic acid, resulting in protein complementation of the two nuclease polypeptide fragments to form the active nuclease protein in the presence of the guide nucleic acid.

In one aspect, described herein is an inducible nuclear split-nuclease polypeptide system comprising (a) a first polypeptide comprising: (i) a first polypeptide fragment of a sequence-specific nuclease (N$^1$); and (ii) a nuclear export signal (NES); and (b) a second polypeptide comprising: (i) a second polypeptide fragment of the sequence-specific nuclease (N$^2$); and (ii) a nuclear localization signal (NLS).

In some embodiments of any of the aspects, the first and second polypeptides come together in the presence of a guide nucleic acid, resulting in protein complementation of the two nuclease polypeptide fragments to form the active nuclease protein in the presence of the guide nucleic acid.

Non-limiting examples of sequestering domain polypeptide systems vectors, polynucleotides, or polypeptides are provided below in Tables 24-25. In Tables 24-25, "Vec." indicates vector. "Nuc." indicates polynucleotide. "Pep." indicates polynucleotide. "Vector Nuc" indicates the start and stop nucleotides of the polypeptide in the vector.

TABLE 24

Exemplary ERT2, NLS, and/or NES Sequences.

| Plasmid Name | Description | SEQ ID NOs | | | Vector Nuc. | |
| --- | --- | --- | --- | --- | --- | --- |
| | | Vec. | Nuc. | Pep. | Start | End |
| CT47_NoNLS | pCAG-PV1-N88-RfxCas13d-ERT2-BGHpA | 1343 | 1415 | 1487 | 4310 | 5560 |
| CT47_YesNLS | pCAG-PV1-N88-RfxCas13d-ERT2-NLS-BGHpA | 1344 | 1416 | 1488 | 4310 | 5581 |
| CT48 | pCAG-PV1-ERT2-89C-RfxCas13d-NLS-BGHpA | 1345 | 1417 | 1489 | 5032 | 8679 |
| CT49_NoNLS | pCAG-PV1-N177-RfxCas13d-ERT2-BGHpA | 1346 | 1418 | 1490 | 4310 | 5827 |
| CT49_YesNLS | pCAG-PV1-N177-RfxCas13d-ERT2-NLS-BGHpA | 1347 | 1419 | 1491 | 4310 | 5848 |
| CT50 | pCAG-PV1-ERT2-178C-RfxCas13d-NLS-BGHpA | 1348 | 1420 | 1492 | 5032 | 8412 |
| CT51_NoNLS | pCAG-PV1-N384-RfxCas13d-ERT2-BGHpA | 1349 | 1421 | 1493 | 4310 | 6448 |
| CT51_YesNLS | pCAG-PV1-N384-RfxCas13d-ERT2-NLS-BGHpA | 1350 | 1422 | 1494 | 4310 | 6449 |
| CT52_NoNLS | pCAG-PV1-ERT2-385C-RfxCas13d-BGHpA | 1351 | 1423 | 1495 | 5032 | 7761 |
| CT52_YesNLS | pCAG-PV1-ERT2-385C-RfxCas13d-NLS-BGHpA | 1352 | 1424 | 1496 | 5032 | 7791 |
| CT53_NoNLS | pCAG-PV1-N559-RfxCas13d-ERT2-BGHpA | 1353 | 1425 | 1497 | 4310 | 6973 |
| CT53_YesNLS | pCAG-PV1-N559-RfxCas13d-ERT2-NLS-BGHpA | 1354 | 1426 | 1498 | 4310 | 6994 |
| CT54_NoNLS | pCAG-PV1-ERT2-560C-RfxCas13d-BGHpA | 1355 | 1427 | 1499 | 5032 | 7236 |
| CT54_YesNLS | pCAG-PV1-ERT2-560C-RfxCas13d-NLS-BGHpA | 1356 | 1428 | 1500 | 5032 | 7266 |
| CT55_NoNLS | pCAG-PV1-N565-RfxCas13d-ERT2-BGHpA | 1357 | 1429 | 1501 | 4310 | 6991 |
| CT55_YesNLS | pCAG-PV1-N565-RfxCas13d-ERT2-NLS-BGHpA | 1358 | 1430 | 1502 | 4310 | 7012 |
| CT56_NoNLS | pCAG-PV1-ERT2-566C-RfxCas13d-BGHpA | 1359 | 1431 | 1503 | 5032 | 7218 |
| CT56_YesNLS | pCAG-PV1-ERT2-566C-RfxCas13d-NLS-BGHpA | 1360 | 1432 | 1504 | 5032 | 7248 |
| CT57_NoNLS | pCAG-PV1-N583-RfxCas13d-ERT2-BGHpA | 1361 | 1433 | 1505 | 4310 | 7045 |
| CT57_YesNLS | pCAG-PV1-N583-RfxCas13d-ERT2-NLS-BGHpA | 1362 | 1434 | 1506 | 4310 | 7066 |
| CT58_NoNLS | pCAG-PV1-ERT2-584C-RfxCas13d-BGHpA | 1363 | 1435 | 1507 | 5032 | 7164 |
| CT58_YesNLS | pCAG-PV1-ERT2-584C-RfxCas13d-NLS-BGHpA | 1364 | 1436 | 1508 | 5032 | 7194 |
| CT59_NoNLS | pCAG-PV1-N655-RfxCas13d-ERT2-BGHpA | 1365 | 1437 | 1509 | 4310 | 7261 |
| CT59_YesNLS | pCAG-PV1-N655-RfxCas13d-ERT2-NLS-BGHpA | 1366 | 1438 | 1510 | 4310 | 7282 |
| CT60_NoNLS | pCAG-PV1-ERT2-656C-RfxCas13d-BGHpA | 1367 | 1439 | 1511 | 5032 | 6948 |
| CT60_YesNLS | pCAG-PV1-ERT2-656C-RfxCas13d-NLS-BGHpA | 1368 | 1440 | 1512 | 5032 | 6978 |
| CT61_NoNLS | pCAG-PV1-N684-RfxCas13d-ERT2-BGHpA | 1369 | 1441 | 1513 | 4310 | 7348 |
| CT61_YesNLS | pCAG-PV1-N684-RfxCas13d-ERT2-NLS-BGHpA | 1370 | 1442 | 1514 | 4310 | 7369 |
| CT62 | pCAG-PV1-ERT2-685C-RfxCas13d-NLS-BGHpA | 1371 | 1443 | 1515 | 5032 | 6891 |
| CT63_NoNLS | pCAG-PV1-N903-RfxCas13d-ERT2-BGHpA | 1372 | 1444 | 1516 | 4310 | 8005 |
| CT63_YesNLS | pCAG-PV1-N903-RfxCas13d-ERT2-NLS-BGHpA | 1373 | 1445 | 1517 | 4310 | 8026 |
| CT64 | pCAG-PV1-ERT2-904C-RfxCas13d-NLS-BGHpA | 1374 | 1446 | 1518 | 5032 | 6234 |
| CT65_NoNLS | pCAG-PV1-N149-RfxCas13d-ERT2-BGHpA | 1375 | 1447 | 1519 | 4310 | 5743 |
| CT65_YesNLS | pCAG-PV1-N149-RfxCas13d-ERT2-NLS-BGHpA | 1376 | 1448 | 1520 | 4310 | 5764 |
| CT66 | pCAG-PV1-ERT2-150C-RfxCas13d-NLS-BGHpA | 1377 | 1449 | 1521 | 5032 | 8496 |
| CT67_NoNLS | pCAG-PV1-N180-RfxCas13d-ERT2-BGHpA | 1378 | 1450 | 1522 | 4310 | 5836 |
| CT67_YesNLS | pCAG-PV1-N180-RfxCas13d-ERT2-NLS-BGHpA | 1379 | 1451 | 1523 | 4310 | 5847 |
| CT68_YesNLS | pCAG-PV1-ERT2-181C-RfxCas13d-NLS-BGHpA | 1380 | 1452 | 1524 | 5032 | 8403 |
| CT69_NoNLS | pCAG-PV1-N215-RfxCas13d-ERT2-BGHpA | 1381 | 1453 | 1525 | 4310 | 5941 |
| CT69_YesNLS | pCAG-PV1-N215-RfxCas13d-ERT2-NLS-BGHpA | 1382 | 1454 | 1526 | 4310 | 5962 |
| CT70 | pCAG-PV1-ERT2-216C-RfxCas13d-NLS-BGHpA | 1383 | 1455 | 1527 | 5032 | 8298 |
| CT71_NoNLS | pCAG-PV1-N263-RfxCas13d-ERT2-BGHpA | 1384 | 1456 | 1528 | 4310 | 6085 |
| CT71_YesNLS | pCAG-PV1-N263-RfxCas13d-ERT2-NLS-BGHpA | 1385 | 1457 | 1529 | 4310 | 6106 |
| CT72 | pCAG-PV1-ERT2-264C-RfxCas13d-NLS-BGHpA | 1386 | 1458 | 1530 | 5032 | 8154 |
| CT73_NoNLS | pCAG-PV1-N317-RfxCas13d-ERT2-BGHpA | 1387 | 1459 | 1531 | 4310 | 6247 |
| CT73_YesNLS | pCAG-PV1-N317-RfxCas13d-ERT2-NLS-BGHpA | 1388 | 1460 | 1532 | 4310 | 6268 |
| CT74 | pCAG-PV1-ERT2-318C-RfxCas13d-NLS-BGHpA | 1389 | 1461 | 1533 | 5032 | 7992 |
| CT75_NoNLS | pCAG-PV1-N340-RfxCas13d-ERT2-BGHpA | 1390 | 1462 | 1534 | 4310 | 6316 |
| CT75_YesNLS | pCAG-PV1-N340-RfxCas13d-ERT2-NLS-BGHpA | 1391 | 1463 | 1535 | 4310 | 6337 |
| CT76 | pCAG-PV1-ERT2-341C-RfxCas13d-NLS-BGHpA | 1392 | 1464 | 1536 | 5032 | 7923 |
| CT77_NoNLS | pCAG-PV1-N404-RfxCas13d-ERT2-BGHpA | 1393 | 1465 | 1537 | 4310 | 6508 |
| CT77_YesNLS | pCAG-PV1-N404-RfxCas13d-ERT2-NLS-BGHpA | 1394 | 1466 | 1538 | 4310 | 6529 |
| CT78 | pCAG-PV1-ERT2-405C-RfxCas13d-NLS-BGHpA | 1395 | 1467 | 1539 | 5032 | 7731 |
| CT79_NoNLS | pCAG-PV1-N473-RfxCas13d-ERT2-BGHpA | 1396 | 1468 | 1540 | 4310 | 6715 |
| CT79_YesNLS | pCAG-PV1-N473-RfxCas13d-ERT2-NLS-BGHpA | 1397 | 1469 | 1541 | 4310 | 6736 |
| CT80 | pCAG-PV1-ERT2-474C-RfxCas13d-NLS-BGHpA | 1398 | 1470 | 1542 | 5032 | 7524 |
| CT81_NoNLS | pCAG-PV1-N507-RfxCas13d-ERT2-BGHpA | 1399 | 1471 | 1543 | 4310 | 6817 |
| CT81_YesNLS | pCAG-PV1-N507-RfxCas13d-ERT2-NLS-BGHpA | 1400 | 1472 | 1544 | 4310 | 6838 |
| CT82_NoNLS | pCAG-PV1-ERT2-508C-RfxCas13d-BGHpA | 1401 | 1473 | 1545 | 5032 | 7392 |

TABLE 24-continued

Exemplary ERT2, NLS, and/or NES Sequences.

| Plasmid Name | Description | SEQ ID NOs Vec. | Nuc. | Pep. | Vector Nuc. Start | End |
|---|---|---|---|---|---|---|
| CT82_YesNLS | pCAG-PV1-ERT2-508C-RfxCas13d-NLS-BGHpA | 1402 | 1474 | 1546 | 5032 | 7422 |
| CT83_NoNLS | pCAG-PV1-N576-RfxCas13d-ERT2-BGHpA | 1403 | 1475 | 1547 | 4310 | 7024 |
| CT83_YesNLS | pCAG-PV1-N576-RfxCas13d-ERT2-NLS-BGHpA | 1404 | 1476 | 1548 | 4310 | 7045 |
| CT84 | pCAG-PV1-ERT2-577C-RfxCas13d-NLS-BGHpA | 1405 | 1477 | 1549 | 5032 | 7215 |
| CT212 | pCAG-PV1-ERT2-RfXCas13d-385C-NLS-ERT2-BGHpA | 1406 | 1478 | 1550 | 442 | 4185 |
| CT213 | pCAG-PV1-ERT2-RfXCas13d-566C-NLS-ERT2-BGHpA | 1407 | 1479 | 1551 | 5032 | 8232 |
| CT214 | pCAG-PV1-ERT2-RfXCas13d-508C-NLS-ERT2-BGHpA | 1408 | 1480 | 1552 | 5032 | 8406 |
| CT215 | pCAG-PV1-NLS-ERT2-RfXCas13d-385C-NLS-ERT2-BGHpA | 1409 | 1481 | 1553 | 5032 | 8796 |
| CT216 | pCAG-PV1-NLS-ERT2-RfXCas13d-566C-NLS-ERT2-BGHpA | 1410 | 1482 | 1554 | 5749 | 509 |
| CT217 | pCAG-PV1-NLS-ERT2-RfXCas13d-508C-NLS-ERT2-BGHpA | 1411 | 1483 | 1555 | 5032 | 8427 |
| CT298 | pCAG-PV1-ERT2-566CRfxCas13d-ERT2-BGHpA | 1412 | 1484 | 1556 | 5032 | 8202 |
| CT299 | pCAG-PV1-ERT2-566CRfxCas13d-NES-ERT2-BGHpA | 1413 | 1485 | 1557 | 5032 | 8238 |
| CT300 | pCAG-PV1-ERT2-508CRfxCas13d-ERT2-BGHpA | 1414 | 1486 | 1558 | 5032 | 8376 |
| CT303 | pCAG-PV1-ERT2-RfxCas13d-ERT2-BGHpA | 1984 | 1985 | 1986 | 442 | 5307 |

TABLE 25

Exemplary NLS Sequences.

| Plasmid Name and Description | SEQ ID NOs Vec. | Nuc. | Pep. | Vector Nuc. Start | End |
|---|---|---|---|---|---|
| CD365 PV1-RfxCas13d-N88-NLS-BGHpA | 1559 | 1610 | 1661 | 3780 | 4070 |
| CD366 PV1-RfxCas13d-89C-NLS-BGHpA | 1560 | 1611 | 1662 | 5032 | 7701 |
| CD367 PV1-RfxCas13d-N177-NLS-BGHpA | 1561 | 1612 | 1663 | 4310 | 4867 |
| CD368 PV1-RfxCas13d-178C-NLS-BGHpA | 1562 | 1613 | 1664 | 4310 | 6712 |
| CD369 PV1-RfxCas13d-N384-NLS-BGHpA | 1563 | 1614 | 1665 | 4848 | 6026 |
| CD370 PV1-RfxCas13d-385C-NLS-BGHpA | 1564 | 1615 | 1666 | 4310 | 6091 |
| CD371 PV1-RfxCas13d-N456-NLS-BGHpA | 1565 | 1616 | 1667 | 4310 | 5704 |
| CD372 PV1-RfxCas13d-457C-NLS-BGHpA | 1566 | 1617 | 1668 | 4310 | 5875 |
| CD373 PV1-RfxCas13d-N559-NLS-BGHpA | 1567 | 1618 | 1669 | 4310 | 6013 |
| CD374 PV1-RfxCas13d-560C-NLS-BGHpA | 1568 | 1619 | 1670 | 4310 | 5566 |
| CD375 PV1-RfxCas13d-N565-NLS-BGHpA | 1569 | 1620 | 1671 | 2202 | 3923 |
| CD376 PV1-RfxCas13d-566C-NLS-BGHpA | 1570 | 1621 | 1672 | 4310 | 5548 |
| CD377 PV1-RfxCas13d-N583-NLS-BGHpA | 1571 | 1622 | 1673 | 4310 | 6085 |
| CD378 PV1-RfxCas13d-584C-NLS-BGHpA | 1572 | 1623 | 1674 | 658 | 1842 |
| CD379 PV1-RfxCas13d-N655-NLS-BGHpA | 1573 | 1624 | 1675 | 558 | 2549 |
| CD380 PV1-RfxCas13d-656C-NLS-BGHpA | 1574 | 1625 | 1676 | 4310 | 5278 |
| CD381 PV1-RfxCas13d-N684-NLS-BGHpA | 1575 | 1626 | 1677 | 2669 | 4747 |
| CD382 PV1-RfxCas13d-685C-NLS-BGHpA | 1576 | 1627 | 1678 | 4310 | 5191 |
| CD383 PV1-RfxCas13d-N747-NLS-BGHpA | 1577 | 1628 | 1679 | 4310 | 6577 |
| CD384 PV1-RfxCas13d-748C-NLS-BGHpA | 1578 | 1629 | 1680 | 4310 | 5002 |
| CD385 PV1-RfxCas13d-N769-NLS-BGHpA | 1579 | 1630 | 1681 | 6596 | 1356 |
| CD386 PV1-RfxCas13d-770C-NLS-BGHpA | 1580 | 1631 | 1682 | 4310 | 4936 |
| CD387 PV1-RfxCas13d-N795-NLS-BGHpA | 1581 | 1632 | 1683 | 6707 | 1467 |
| CD388 PV1-RfxCas13d-796C-NLS-BGHpA | 1582 | 1633 | 1684 | 2608 | 3156 |
| CD389 PV1-RfxCas13d-N807-NLS-BGHpA | 1583 | 1634 | 1685 | 4577 | 7024 |
| CD390 PV1-RfxCas13d-808C-NLS-BGHpA | 1584 | 1635 | 1686 | 2352 | 2864 |
| CD391 PV1-RfxCas13d-N903-NLS-BGHpA | 1585 | 1636 | 1687 | 4310 | 7045 |
| CD392 PV1-RfxCas13d-904C-NLS-BGHpA | 1586 | 1637 | 1688 | 4310 | 4534 |
| CT27 pCAG-PV1-RfxCas13d-N149-NLS-BGHpA | 1587 | 1638 | 1689 | 4310 | 4783 |
| CT28 pCAG-PV1-RfxCas13d-150C-NLS-BGHpA | 1588 | 1639 | 1690 | 4310 | 6796 |
| CT29 pCAG-PV1-RfxCas13d-N180-NLS-BGHpA | 1589 | 1640 | 1691 | 3780 | 4346 |
| CT30 pCAG-PV1-RfxCas13d-181C-NLS-BGHpA | 1590 | 1641 | 1692 | 5032 | 7425 |
| CT31 pCAG-PV1-RfxCas13d-N215-NLS-BGHpA | 1591 | 1642 | 1693 | 558 | 1229 |
| CT32 pCAG-PV1-RfxCas13d-216C-NLS-BGHpA | 1592 | 1643 | 1694 | 4310 | 6598 |
| CT33 pCAG-PV1-RfxCas13d-N263-NLS-BGHpA | 1593 | 1644 | 1695 | 4310 | 5125 |
| CT34 pCAG-PV1-RfxCas13d-264C-NLS-BGHpA | 1594 | 1645 | 1696 | 4310 | 6454 |
| CT35 pCAG-PV1-RfxCas13d-N317-NLS-BGHpA | 1595 | 1646 | 1697 | 4310 | 5287 |
| CT36 pCAG-PV1-RfxCas13d-318C-NLS-BGHpA | 1596 | 1647 | 1698 | 661 | 2640 |
| CT37 pCAG-PV1-RfxCas13d-N340-NLS-BGHpA | 1597 | 1648 | 1699 | 4848 | 5894 |
| CT38 pCAG-PV1-RfxCas13d-341C-NLS-BGHpA | 1598 | 1649 | 1700 | 4310 | 6223 |
| CT39 pCAG-PV1-RfxCas13d-N404-NLS-BGHpA | 1599 | 1650 | 1701 | 4310 | 5548 |

TABLE 25-continued

Exemplary NLS Sequences.

| Plasmid Name and Description | Vec. | SEQ ID NOs Nuc. | Pep. | Vector Nuc. Start | End |
|---|---|---|---|---|---|
| CT40 pCAG-PV1-RfxCas13d-405C-NLS-BGHpA | 1600 | 1651 | 1702 | 4310 | 6031 |
| CT41 pCAG-PV1-RfxCas13d-N473-NLS-BGHpA | 1601 | 1652 | 1703 | 4310 | 5755 |
| CT42 pCAG-PV1-RfxCas13d-474C-NLS-BGHpA | 1602 | 1653 | 1704 | 4310 | 5824 |
| CT43 pCAG-PV1-RfxCas13d-N507-NLS-BGHpA | 1603 | 1654 | 1705 | 2202 | 3749 |
| CT44 pCAG-PV1-RfxCas13d-508C-NLS-BGHpA | 1604 | 1655 | 1706 | 4310 | 5722 |
| CT45 pCAG-PV1-RfxCas13d-N576-NLS-BGHpA | 1605 | 1656 | 1707 | 4310 | 6064 |
| CT46 pCAG-PV1-RfxCas13d-577C-NLS-BGHpA | 1606 | 1657 | 1708 | 2352 | 3557 |
| CT209 pCAG-PV1-RfxCas13d-N384-NPM2NLSR7-BGHpA | 1607 | 1658 | 1709 | 4848 | 6077 |
| CT210 pCAG-PV1-RfxCas13d-N565-NPM2NLSR7-BGHpA | 1608 | 1659 | 1710 | 2202 | 3974 |
| CT211 pCAG-PV1-RfxCas13d-N507-NPM2NLSR7-BGHpA | 1609 | 1660 | 1711 | 2202 | 3800 |

TABLE 30

Exemplary ERT2, NLS, and/or NES Sequences.

| Plasmid Name | Description | Vec. | SEQ ID NOs Nuc. | Pep. | Vector Nuc. Start | End |
|---|---|---|---|---|---|---|
| CT48 | pCAG-PV1-ERT2-89C-RfxCas13d-NLS-BGHpA | 1890 | 1919 | 1948 | 5032 | 8682 |
| CT50 | pCAG-PV1-ERT2-178C-RfxCas13d-NLS-BGHpA | 1891 | 1920 | 1949 | 5032 | 8415 |
| CT52 | pCAG-PV1-ERT2-385C-RfxCas13d-NLS-BGHpA | 1892 | 1921 | 1950 | 5032 | 7794 |
| CT54 | pCAG-PV1-ERT2-560C-RfxCas13d-NLS-BGHpA | 1893 | 1922 | 1951 | 5032 | 7269 |
| CT56 | pCAG-PV1-ERT2-566C-RfxCas13d-NLS-BGHpA | 1894 | 1923 | 1952 | 5032 | 7251 |
| CT58 | pCAG-PV1-ERT2-584C-RfxCas13d-NLS-BGHpA | 1895 | 1924 | 1953 | 5032 | 7197 |
| CT60 | pCAG-PV1-ERT2-656C-RfxCas13d-NLS-BGHpA | 1896 | 1925 | 1954 | 5032 | 6981 |
| CT62 | pCAG-PV1-ERT2-685C-RfxCas13d-NLS-BGHpA | 1897 | 1926 | 1955 | 5032 | 6894 |
| CT64 | pCAG-PV1-ERT2-904C-RfxCas13d-NLS-BGHpA | 1898 | 1927 | 1956 | 5032 | 6237 |
| CT66 | pCAG-PV1-ERT2-150C-RfxCas13d-NLS-BGHpA | 1899 | 1928 | 1957 | 5032 | 8499 |
| CT68 | pCAG-PV1-ERT2-181C-RfxCas13d-NLS-BGHpA | 1900 | 1929 | 1958 | 5032 | 8406 |
| CT70 | pCAG-PV1-ERT2-216C-RfxCas13d-NLS-BGHpA | 1901 | 1930 | 1959 | 5032 | 8301 |
| CT72 | pCAG-PV1-ERT2-264C-RfxCas13d-NLS-BGHpA | 1902 | 1931 | 1960 | 5032 | 8157 |
| CT74 | pCAG-PV1-ERT2-318C-RfxCas13d-NLS-BGHpA | 1903 | 1932 | 1961 | 5032 | 7995 |
| CT76 | pCAG-PV1-ERT2-341C-RfxCas13d-NLS-BGHpA | 1904 | 1933 | 1962 | 5032 | 7926 |
| CT78 | pCAG-PV1-ERT2-405C-RfxCas13d-NLS-BGHpA | 1905 | 1934 | 1963 | 5032 | 7734 |
| CT80 | pCAG-PV1-ERT2-474C-RfxCas13d-NLS-BGHpA | 1906 | 1935 | 1964 | 5032 | 7527 |
| CT82 | pCAG-PV1-ERT2-508C-RfxCas13d-NLS-BGHpA | 1907 | 1936 | 1965 | 5032 | 7425 |
| CT84 | pCAG-PV1-ERT2-577C-RfxCas13d-NLS-BGHpA | 1908 | 1937 | 1966 | 5032 | 7218 |
| CT212 | pCAG-PV1-ERT2-RfXCas13d-385C-NLS-ERT2-BGHpA | 1909 | 1938 | 1967 | 442 | 4185 |
| CT213 | pCAG-PV1-ERT2-RfXCas13d-566C-NLS-ERT2-BGHpA | 1910 | 1939 | 1968 | 5032 | 8232 |
| CT214 | pCAG-PV1-ERT2-RfXCas13d-508C-NLS-ERT2-BGHpA | 1911 | 1940 | 1969 | 5032 | 8406 |
| CT215 | pCAG-PV1-NLS-ERT2-RfXCas13d-385C-NLS-ERT2-BGHpA | 1912 | 1941 | 1970 | 5032 | 8796 |
| CT216 | pCAG-PV1-NLS-ERT2-RfXCas13d-566C-NLS-ERT2-BGHpA | 1913 | 1942 | 1971 | 5749 | 509 |
| CT217 | pCAG-PV1-NLS-ERT2-RfXCas13d-508C-NLS-ERT2-BGHpA | 1914 | 1943 | 1972 | 5032 | 8427 |
| CT298 | pCAG-PV1-ERT2-566CRfxCas13d-ERT2-BGHpA | 1915 | 1944 | 1973 | 5032 | 8202 |
| CT299 | pCAG-PV1-ERT2-566CRfxCas13d-NES-ERT2-BGHpA | 1916 | 1945 | 1974 | 5032 | 8238 |
| CT300 | pCAG-PV1-ERT2-508CRfxCas13d-ERT2-BGHpA | 1917 | 1946 | 1975 | 5032 | 8376 |
| CT303 | pCAG-PV1-ERT2-RfxCas13d-ERT2-BGHpA | 1918 | 1947 | 1976 | 442 | 5310 |

In some embodiments of any of the aspects, a sequestering domain polypeptide system comprises a first polypeptide selected from Table 24 or Table 25 and a second polypeptide selected from the same table (e.g., Table 24 or Table 25). In some embodiments of any of the aspects, the first polypeptide comprises an N-terminal fragment of Cas13d, and the second polypeptide in the same system comprises the C-terminal fragment of Cas13d that complements the N-terminal fragment (e.g., N88 and 89C). In some embodiments of any of the aspects, a second polypeptide (e.g., C-terminal Cas13d fragment; or vector or polynucleotide encoding the polypeptide) can be selected from Table 30 in place of a second polypeptide (or vector or polynucleotide encoding the polypeptide) from Table 24 with the same plasmid name and/or description. As a non-limiting example, SEQ ID NOs: 1948, 1949, 1950, 1951, 1952, 1953, 1954, 1955, 1956, 1957, 1958, 1959, 1960, 1%1, 1%2, 1%3, 1964, 1%5, 1966, 1%7, 1968, 1%9, 1970, 1971, 1972, 1973, 1974, 1975, or 1976 can be selected in place of SEQ ID NOs: 1489, 1492, 14%, 1500, 1504, 1508, 1512, 1515, 1518, 1521, 1524, 1527, 1530, 1533, 1536, 1539, 1542, 1546, 1549, 1550, 1551, 1552, 1553, 1554, 1555, 1556, 1557, 1558, or 1986, respectively, or vice versa.

In some embodiments of any of the aspects, the polypeptide comprises one of SEQ ID NOs: 1487-1558, 1661-1711, 1948-1975, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 1487-1558 or 1661-1711, or 1948-1975, that maintains the same function.

In some embodiments of any of the aspects, the polypeptide comprises one of SEQ ID NOs: 1487-1558, 1661-1711, 1948-1976, 1986, or an amino acid sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to one of SEQ ID NOs: 1487-1558 or 1661-1711, 1948-1975, or 1986 that maintains the same function.

In multiple aspects, described herein are polynucleotides that encode for polypeptides or polypeptide systems as described herein. In some embodiments of any of the aspects, a polynucleotide comprises one of SEQ ID NOs: 279-336, 455-514, 655-734, 873-930, 1067-1144, 1263-1302, 1415-1486, 1610-1660, 1790-1839, 1919-1947, 1985, 2010-2031, 2093-2128 (see e.g., Tables 18-26, 29, 30, 32-33), or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of SEQ ID NOs: 279-336, 455-514, 655-734, 873-930, 1067-1144, 1263-1302, 1415-1486, 1610-1660, 1790-1839, 1919-1947, 1985, 2010-2031, or 2093-2128 that as a polypeptide maintains the same functions.

In some embodiments, the polynucleotide is a codon-optimized version of one of SEQ ID NOs: 279-336, 455-514, 655-734, 873-930, 1067-1144, 1263-1302, 1415-1486, 1610-1660, 1790-1839, 1919-1947, 1985, 2010-2031, or 2093-2128. In some embodiments of any of the aspects, the vector or nucleic acid described herein is codon-optimized, e.g., the native or wild-type sequence of the nucleic acid sequence has been altered or engineered to include alternative codons such that altered or engineered nucleic acid encodes the same polypeptide expression product as the native/wild-type sequence, but can be transcribed and/or translated at an improved efficiency in a desired expression system. In some embodiments of any of the aspects, the expression system is an organism other than the source of the native/wild-type sequence (or a cell obtained from such organism). In some embodiments of any of the aspects, the vector and/or nucleic acid sequence described herein is codon-optimized for expression in a mammal or mammalian cell, e.g., a mouse, a murine cell, or a human cell. In some embodiments of any of the aspects, the vector and/or nucleic acid sequence described herein is codon-optimized for expression in a human cell. In some embodiments of any of the aspects, the vector and/or nucleic acid sequence described herein is codon-optimized for expression in a yeast or yeast cell. In some embodiments of any of the aspects, the vector and/or nucleic acid sequence described herein is codon-optimized for expression in a bacterial cell. In some embodiments of any of the aspects, the vector and/or nucleic acid sequence described herein is codon-optimized for expression in an *E. coli* cell.

In some embodiments, one or more of the genes described herein is expressed in a recombinant expression vector or plasmid. As used herein, the term "vector" refers to a polynucleotide sequence suitable for transferring transgenes into a host cell. The term "vector" includes plasmids, mini-chromosomes, phage, naked DNA and the like. See, for example, U.S. Pat. Nos. 4,980,285; 5,631,150; 5,707,828; 5,759,828; 5,888,783 and, 5,919,670, and, Sambrook et al, Molecular Cloning: A Laboratory Manual, 2nd Ed., Cold Spring Harbor Press (1989). One type of vector is a "plasmid," which refers to a circular double stranded DNA loop into which additional DNA segments are ligated. Another type of vector is a viral vector, wherein additional DNA segments are ligated into the viral genome. Certain vectors are capable of autonomous replication in a host cell into which they are introduced (e.g., bacterial vectors having a bacterial origin of replication and episomal mammalian vectors). Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" is used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

A cloning vector is one which is able to replicate autonomously or integrated in the genome in a host cell, and which is further characterized by one or more endonuclease restriction sites at which the vector may be cut in a determinable fashion and into which a desired DNA sequence can be ligated such that the new recombinant vector retains its ability to replicate in the host cell. In the case of plasmids, replication of the desired sequence can occur many times as the plasmid increases in copy number within the host cell such as a host bacterium or just a single time per host before the host reproduces by mitosis. In the case of phage, replication can occur actively during a lytic phase or passively during a lysogenic phase.

An expression vector is one into which a desired DNA sequence can be inserted by restriction and ligation such that it is operably joined to regulatory sequences and can be expressed as an RNA transcript. Vectors can further contain one or more marker sequences suitable for use in the identification of cells which have or have not been transformed or transformed or transfected with the vector. Markers include, for example, genes encoding proteins which increase or decrease either resistance or sensitivity to antibiotics or other compounds, genes which encode enzymes whose activities are detectable by standard assays known in the art (e.g., β-galactosidase, luciferase or alkaline phosphatase), and genes which visibly affect the phenotype of transformed or transfected cells, hosts, colonies or plaques (e.g., green fluorescent protein). In certain embodiments, the vectors used herein are capable of autonomous replication and expression of the structural gene products present in the DNA segments to which they are operably joined.

As used herein, a coding sequence and regulatory sequences are said to be "operably" joined when they are covalently linked in such a way as to place the expression or transcription of the coding sequence under the influence or control of the regulatory sequences. If it is desired that the coding sequences be translated into a functional protein, two DNA sequences are said to be operably joined if induction of a promoter in the 5' regulatory sequences results in the transcription of the coding sequence and if the nature of the linkage between the two DNA sequences does not (1) result in the introduction of a frame-shift mutation, (2) interfere with the ability of the promoter region to direct the transcription of the coding sequences, or (3) interfere with the ability of the corresponding RNA transcript to be translated into a protein. Thus, a promoter region would be operably joined to a coding sequence if the promoter region were capable of effecting transcription of that DNA sequence such that the resulting transcript can be translated into the desired protein or polypeptide.

When the nucleic acid molecule that encodes any of the polypeptides described herein is expressed in a cell, a variety of transcription control sequences (e.g., promoter/enhancer sequences) can be used to direct its expression. The promoter can be a native promoter, i.e., the promoter of the gene in its endogenous context, which provides normal regulation of expression of the gene. In some embodiments the promoter can be constitutive, i.e., the promoter is unregulated allowing for continual transcription of its associated gene. A variety of conditional promoters also can be used, such as promoters controlled by the presence or absence of a molecule.

The precise nature of the regulatory sequences needed for gene expression can vary between species or cell types, but in general can include, as necessary, 5' non-transcribed and 5' non-translated sequences involved with the initiation of transcription and translation respectively, such as a TATA box, capping sequence, CAAT sequence, and the like. In particular, such 5' non-transcribed regulatory sequences can include a promoter region which includes a promoter sequence for transcriptional control of the operably joined gene. Regulatory sequences can also include enhancer sequences or upstream activator sequences as desired. The vectors of the invention may optionally include 5' leader or signal sequences. The choice and design of an appropriate vector is within the ability and discretion of one of ordinary skill in the art.

In some embodiments of any of the aspects, the promoter is a eukaryotic or human constitutive promoter, including but not limited to CAG, CMV, EF-1alpha, SFFV, and the like. In some embodiments of any of the aspects, the vector comprises a human elongation factor-1 alpha (EF-1alpha) promoter, which is a constitutive promoter of human origin that can be used to drive ectopic gene expression in various in vitro and in vivo contexts. In some embodiments of any of the aspects, the vector comprises a silencing-prone spleen focus forming virus (SFFV) promoter, which can result in a higher level of constitutive transgene expression compared with CMV or EF1α promoters. In some embodiments of any of the aspects, the vector comprises a Kozak sequence (e.g., GCCGCCACC), which is a nucleic acid motif that functions as the protein translation initiation site in eukaryotic mRNA transcripts.

In some embodiments of any of the aspects, the vector or polynucleotide comprises an inducible promoter. In some embodiments of any of the aspects, the polynucleotide encoding the first polypeptide is operatively linked to an inducible promoter. In some embodiments of any of the aspects, the polynucleotide encoding the second polypeptide is operatively linked to an inducible promoter. In some embodiments of any of the aspects, the polynucleotide encoding the first polypeptide and the polynucleotide encoding the second polypeptide are each operatively linked to an inducible promoter. Accordingly, in one aspect described herein is a polynucleotide system comprising: (a) a first polynucleotide encoding for a first polypeptide as described herein (e.g., N-terminal polypeptide fragment); and (b) a second polynucleotide encoding for a second polypeptide as described herein (e.g., C-terminal polypeptide fragment). In some embodiments of any of the aspects, the first and/or second polynucleotide is operatively linked to an inducible promoter.

In some embodiments of any of the aspects, the inducible promoter is a pAP1, pNFkB, pCAGA12, or pSTF inducible promoter. In some embodiments of any of the aspects, the inducible promoter is induced by PMA (e.g., pAP1), TGFβ (e.g., pNFkB), TNFa (e.g., pCAGA), or WNT (e.g., pSTF). In some embodiments of any of the aspects, the inducible promoter is a pAP1, pNFkB, or pCAGA12 inducible promoter. In some embodiments of any of the aspects, the inducible promoter is induced by PMA (e.g., pAP1), TGFβ (e.g., pNFkB), or TNFa (e.g., pCAGA); see e.g., FIG. 13A-13E. In some embodiments of any of the aspects, the inducible promoter is a doxycycline inducible promoter (e.g., Tet-Off or Tet-On gene expression systems). Non-limiting examples of polypeptide systems comprising at least one inducible promoter are provided in Table 26 below. In Table 26, "Vec." indicates vector. "Nuc." indicates polynucleotide. "Pep." indicates polynucleotide. "Vector Nuc" indicates the start and stop nucleotides of the polypeptide in the vector. Bolded sequences indicate exemplary embodiments that showed the highest performance in the tested conditions.

TABLE 26

Exemplary Inducible Promoter System Sequences.

| Plasmid Name and Description | SEQ ID NOs | | | Vector Nuc. | |
|---|---|---|---|---|---|
| | Vec. | Nuc. | Pep. | Start | End |
| CD754_pAAVS1-pAP1(2)-Cas13d N559 | 1712 | 1618 | 1669 | 1062 | 2765 |
| CD755_pAAVS1-pAP1(2)-Cas13d 560C | 1713 | 1619 | 1670 | 1062 | 2318 |
| CD756_pAAVS1-pAP1(2)-Cas13d | 1714 | 1734 | 1735 | 1062 | 4067 |
| CD758_pAAVS1-pSTF-Cas13d N559 | 1715 | 1618 | 1669 | 1201 | 2904 |
| CD759_pAAVS1-pSTF-Cas13d 560C | 1716 | 1619 | 1670 | 1201 | 2457 |
| CD760_pAAVS1-pSTF-Cas13d | 1717 | 1734 | 1735 | 1201 | 4206 |
| CD762_pAAVS1-pNFkB-Cas13d N559 | 1718 | 1618 | 1669 | 1076 | 2779 |
| CD763_pAAVS1-pNFkB-Cas13d 560C | 1719 | 1619 | 1670 | 1076 | 2332 |
| CD764_pAAVS1-pNFkB-Cas13d | 1720 | 1734 | 1735 | 1076 | 4078 |
| CD766 pAAVS1-CAGA12-N559 | 1721 | 1618 | 1669 | 1167 | 2870 |
| CD767 pAAVS1-CAGA12-560C | 1722 | 1619 | 1670 | 1167 | 2423 |
| CD768 pAAVS1-CAGA12-Cas13d | 1723 | 1734 | 1735 | 1167 | 4169 |
| CD811_pAAVS1-pAP1(2)-Cas13d N559 PGK-Zeocin-P2A-BFP | 1724 | 1618 | 1669 | 1062 | 2765 |
| CD812_pAAVS1-pAP1(2)-Cas13d 560C PGK-Zeocin-P2A-BFP | 1725 | 1619 | 1670 | 1062 | 2318 |
| CD813_pAAVS1-pAP1(2)-Cas13d PGK-Zeocin-P2A-BFP | 1726 | 1734 | 1735 | 1062 | 4067 |
| CD815_pAAVS1-pNFkB-Cas13d N559 PGK-Zeocin-P2A-BFP | 1727 | 1618 | 1669 | 1076 | 2779 |
| CD816_pAAVS1-pNFkB-Cas13d 560C PGK-Zeocin-P2A-BFP | 1728 | 1619 | 1670 | 1076 | 2332 |
| CD 817_pAAVS1-pNFkB-Cas13d PGK-Zeocin-P2A-BFP | 1729 | 1734 | 1735 | 1076 | 4078 |

TABLE 26-continued

Exemplary Inducible Promoter System Sequences.

| Plasmid Name and Description | SEQ ID NOs | | | Vector Nuc. | |
|---|---|---|---|---|---|
| | Vec. | Nuc. | Pep. | Start | End |
| Control Plasmids | | | | | |
| CD757_pAAVS1-pAP1(2)-1RFP | | 1730 | | N/A | |
| CD761_pAAVS1-pSTF-GFP | | 1731 | | N/A | |
| CD765_pAAVS1-pNFkB-BFP | | 1732 | | N/A | |
| CD769 pAAVS1-CAGA12-mCherry | | 1733 | | N/A | |

Any polypeptide or system described herein (e.g., inducible dimerization polypeptides and systems thereof, repressible dimerization polypeptides and systems thereof, inducible nuclease split-recombinase polypeptides and systems thereof) can further comprise at least one inducible promoter to add a second dimension of control to the system (e.g., an AND-Gate). In some embodiments of any of the aspects, the first control for such an AND-gate system is the inducer agent or signal, the repressor agent or signal, or a guide nucleic acid(s) and target nucleic acid(s) specific to the system. In some embodiments of any of the aspects, the second control for such an AND-gate system is the ligand for the inducible promoter.

In some embodiments of any of the aspects, a repressible polypeptide system comprises a first and second polypeptide selected from Table 26. In some embodiments of any of the aspects, the first polypeptide comprises an N-terminal fragment of Cas13d, and the second polypeptide in the same system comprises the C-terminal fragment of Cas13d that complements the N-terminal fragment (e.g., N559 and 560C). In some embodiments of any of the aspects, the system is selected from a group of embodiments that showed the highest performance in the tested conditions, including SEQ ID NO: 1791.

Non-limiting examples of inducible promoter sequences are provided in Table 27 below.

TABLE 27

Exemplary Inducible Promoters.

| Inducible Promoter | Sequence | SEQ ID NO | Inducer |
|---|---|---|---|
| pAP1 (also referred to as a minimal thymidine kinase promoter (PminiTK)) | TTCGCATATTAAGG TGACGCGTGTGGCC TCGAACACCGAGCG ACCCTGCAGCGACC CGCTTAA | 1736 | PMA (phorbol 12-myristate 13-acetate) |
| pNFkB (bolded text indicates NFkB binding sites 1-16 (GGGAATTTCC); italicized text indicates miniP with pTA) | GGGAATTTCCGGGA ATTTCCGGGAATTT CCGGGAATTTCCGG GAATTTCCGGGAAT TTCCGCTAGCCCGG GCTCGAGATCTAGA CTC*TAGAGGGTATA TAATGGAAGCTCGA ATTCCAG* | 1737 | TGFβ |
| pCAGA12 | AGCCAGACAAAAAG CCAGACATTTAGCC AGACACTCGAGAGC CAGACAAAAGCCA GACATTTAGCCAGA CACTCGAGAGCCAG | 1738 | TNFa |

TABLE 27-continued

Exemplary Inducible Promoters.

| Inducible Promoter | Sequence | SEQ ID NO | Inducer |
|---|---|---|---|
| | ACAAAAAGCCAGAC ATTTAGCCAGACAC TCGAGAGCCAGACA AAAAGCCAGACATT TAGCCAGACACTCG AGATCTGGGCTATA AAAGGGGTGGGGG CGCGTTCGTCCTCA CTCTCTTCC | | |
| pSTF (super top flash; bolded text indicates STF elements 1-12; italicized text indicates miniP with pTA) | GATCAAAGGGGGTA AGATCAAAGGGGGT AAGATCAAAGGGGG TAAGATCAAAGGGG GTAAGATCAAAGGG GGTAAGATCAAAGG GCGCTAGATCAAAG GGGGTAAGATCAAA GGGGGTAAGATCAA AGGGGGTAAGATAA AGGGGGTAAGATCA AAGGGGGTAAGATC AAAGGCGCTAGCC CGGGCTCGAGATCT AGACTC*TAGAGGGT ATATAATGGAAGCT CGAATTCCAG* | 1739 | Wnt |

In some embodiments of any of the aspects, an inducible promoter comprises one of SEQ ID NOs: 1736-1739 (see e.g., Tables 26-27) or a sequence that is at least 70%, at least 75%, at least 80%, at least 85%, at least 90%, at least 90%, at least 91%, at least 92%, at least 93%, at least 94%, at least 95%, at least 96%, at least 97%, at least 98%, or at least 99% identical to the sequence of one of SEQ ID NOs: 1736-1739, that maintains the same functions (e.g., inducible promoter; e.g., inducible expression of operatively linked polynucleotide).

Expression vectors containing all the necessary elements for expression are commercially available and known to those skilled in the art. See, e.g., Sambrook et al., *Molecular Cloning: A Laboratory Manual*, Second Edition, Cold Spring Harbor Laboratory Press, 1989. Cells are genetically engineered by the introduction into the cells of heterologous DNA (RNA). That heterologous DNA (RNA) is placed under operable control of transcriptional elements to permit the expression of the heterologous DNA in the host cell.

In some embodiments of any of the aspects, a vector comprises one of SEQ ID NOs: 221-278, 395-454, 575-654, 815-872, 989-1066, 1223-1262, 1343-1414, 1559-1609, 1712-1733, 1740-1789, 1890-1918, 1984, 1987-2008, 2056-

2091 (see e.g., Tables 18-26, 29, 30, 32-33) or a sequence that is at least 70%, at least 75%, at least 80%, at least 85%, at least 90%, at least 90%, at least 910%, at least 92%, at least 93%, at least 94%, at least 95%, at least 96%, at least 97%, at least 98%, or at least 99% identical to the sequence of one of SEQ ID NOs: 221-278, 395-454, 575-654, 815-872, 989-1066, 1223-1262, 1343-1414, 1559-1609, 1712-1733, 1740-1789, 1890-1918, 1984, 1987-2008, or 2056-2091 that maintains the same functions (e.g., expression vector or viral vector, polypeptide expression).

In some embodiments, the vector is a pV1 expression vector comprising a CAG promoter, also referred to herein as a pCAG expression vector. In some embodiments of any of the aspects, the expression vector further comprises a polyadenylation site. As a non-limiting example, the bovine growth hormone polyadenylation (bgh-PolyA, also referred to herein as BGHpA) signal is a specialized termination sequence for protein expression in eukaryotic cells.

In some embodiments, the vector is a pAAVS1 viral vector. Adeno-associated virus integration site 1 is a viral integration site that in humans is encoded by the AAVS1 gene located on chromosome 19. In some embodiments of any of the aspects, the viral vector comprises two homology arms for the AAVS1 gene, allowing for integration of the polypeptide within the two homology arms in the subject's genome.

In some embodiments, the vector is a lentiviral vector. The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses. The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Nonclinical types of lentiviral vectors are also available and would be known to one skilled in the art.

In some embodiments of any of the aspects, the lentiviral vector comprises a central polypurine tract (cPPT). A central polypurine tract/central termination sequence creates a "DNA flap" that increases nuclear importation of the viral genome during target-cell infection. The cPPTICTS element improves vector integration and transduction efficiency. In some embodiments of any of the aspects, the lentiviral vector comprises a woodchuck hepatitis virus posttranscriptional regulatory element (WPRE), which prevents poly(A) site read-through, promotes RNA processing and maturation, and increases nuclear export of RNA. In genomic transcripts, it enhances vector packaging and increases titer. In transduced target cells, the WPRE boosts transgene expression by facilitating mRNA transcript maturation.

Without limitations, the genes described herein can be included in one vector or separate vectors. For example, the first inducible polypeptide gene and the second inducible polypeptide gene can be included in the same vector; or the first repressible polypeptide gene and the second repressible polypeptide gene can be included in the same vector; or the first inducible nuclease split-recombinase polypeptide gene and the second inducible nuclease split-recombinase polypeptide gene can be included in the same vector; or the first sequestering domain polypeptide gene and the second sequestering domain gene can be included in the same vector.

For example, the first inducible polypeptide gene can be included in a first vector, and the second inducible polypeptide gene can be included in a second vector; or the first repressible polypeptide gene can be included in a first vector, and the second repressible polypeptide gene can be included in a second vector; or the first inducible nuclease split-recombinase polypeptide gene can be included in a first vector, and the second inducible nuclease split-recombinase polypeptide gene can be included in a second vector; or the first sequestering domain polypeptide gene can be included in a first vector, and the second sequestering domain gene can be included in a second vector.

In some embodiments, the vector comprises a selectable marker, e.g., for selectively amplifying the vector in bacteria. Non-limiting examples of selectable marker genes for use in bacteria include antibiotic resistance genes conferring resistance to ampicillin, tetracycline and kanamycin. The tetracycline (tet) and ampicillin (amp) resistance marker genes can be obtained from any of a number of commercially available vectors including pBR322 (available from New England BioLabs, Beverly, Mass., cat. no. 303-3s). The tet coding sequence is contained within nucleotides 86-476; the amp gene is contained within nucleotides 3295-4155. The nucleotide sequence of the kanamycin (kan) gene is available from vector pACYC 177, from New England BioLabs, Cat no. 401-L, GenBank accession No. X06402.

In some embodiments, one or more of the recombinantly expressed genes can be integrated into the genome of the cell.

A nucleic acid molecule that encodes the polypeptide of the claimed invention can be introduced into a cell or cells using methods and techniques that are standard in the art. For example, nucleic acid molecules can be introduced by standard protocols such as transformation including chemical transformation and electroporation, transduction, particle bombardment, etc. Expressing the nucleic acid molecule encoding the enzymes of the claimed invention also may be accomplished by integrating the nucleic acid molecule into the genome.

In one aspect, described herein is a cell or population thereof comprising the at least one polypeptide, system, polynucleotide, or vector as described herein (see e.g., Tables 18-26, 29-33). In some embodiments of any of the aspects, the cell or population thereof can comprise any combination of polypeptides or systems (see e.g., Table 17).

In some embodiments of any of the aspects, the cell comprises an immune cell. In some embodiments of any of the aspects, the immune cell comprises a CD4+ T cell, a CD8+ T cell, a regulatory T cell (Treg), or a natural killer (NK) cell. In one embodiment, the cell comprises a T cell. In other embodiments, the cell comprises a B cell.

In some embodiments of any of the aspects, the cells are isolated from a subject. The term "isolated" as used herein signifies that the cells are placed into conditions other than their natural environment. The term "isolated" does not preclude the later use of these cells thereafter in combinations or mixtures with other cells. In some embodiments of any of the aspects, an immune cell (e.g., T cell) is: (a) isolated from the subject; (b) genetically modified to express a polypeptide or system as described herein; and (c) administered to the subject. In some embodiments of any of the aspects, the cells are isolated from a first subject and administered to a second subject. In some embodiments of any of the aspects, the immune cells are first differentiated from a somatic cell sample from the subject and then genetically modified to express a polypeptide or system as described herein.

Figure 7A:
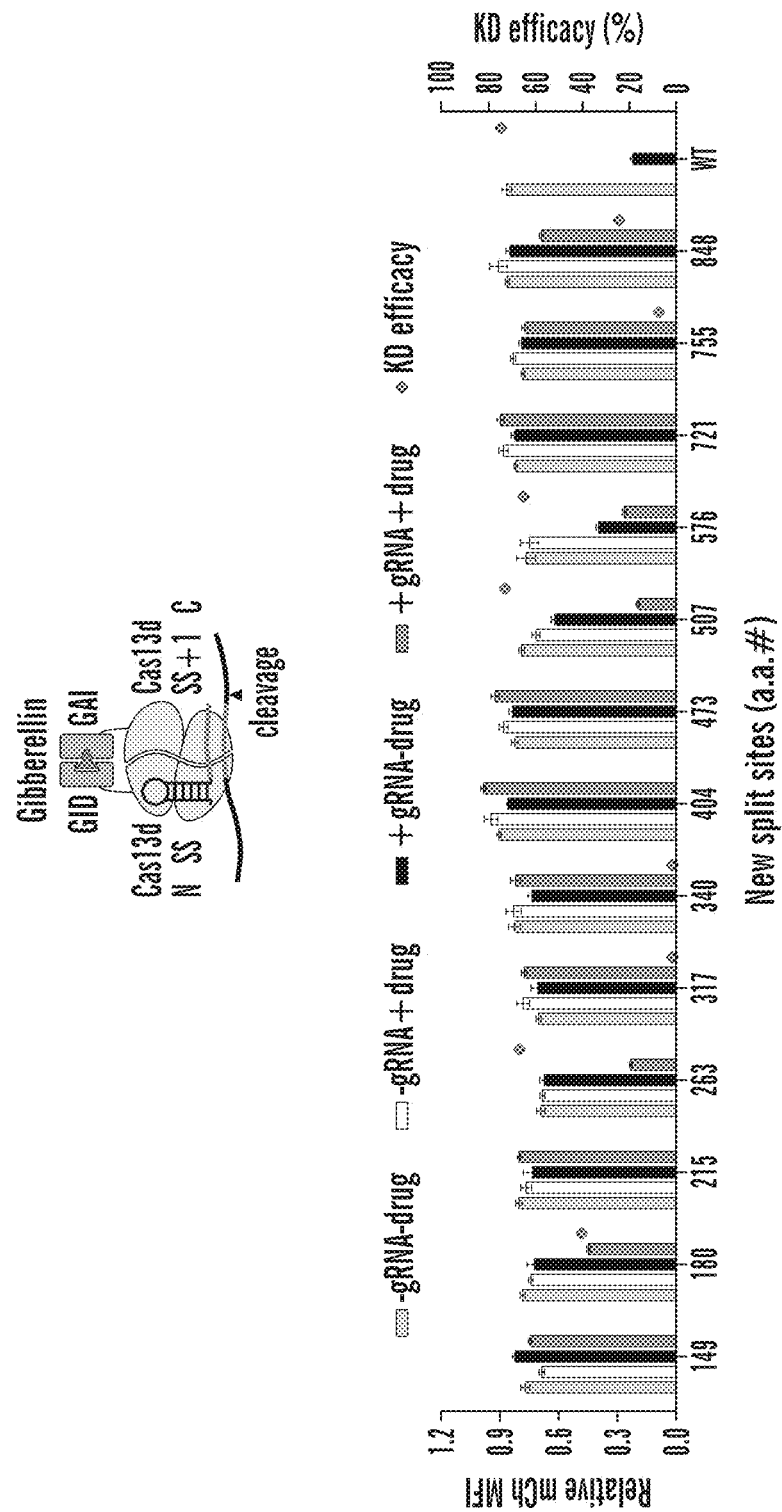
FIG. 7A-7E is a series of schematics and graphs showing a functional and inducible split Cas13d design.
Figure 7B:
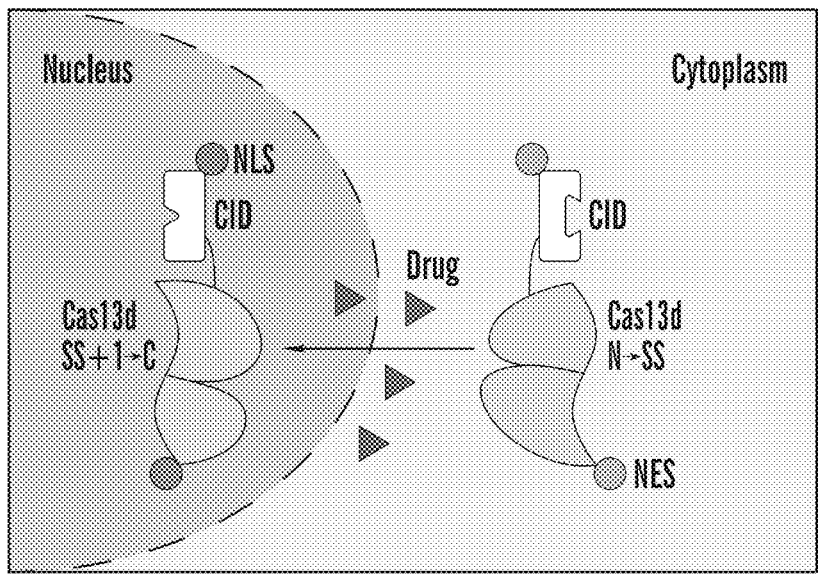
Figure 7C:
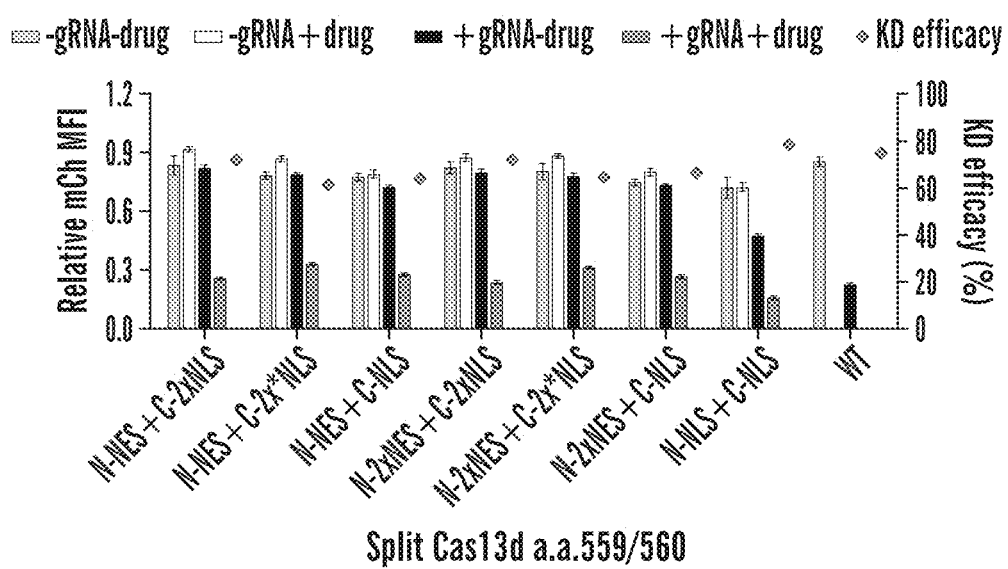
Figure 7D:
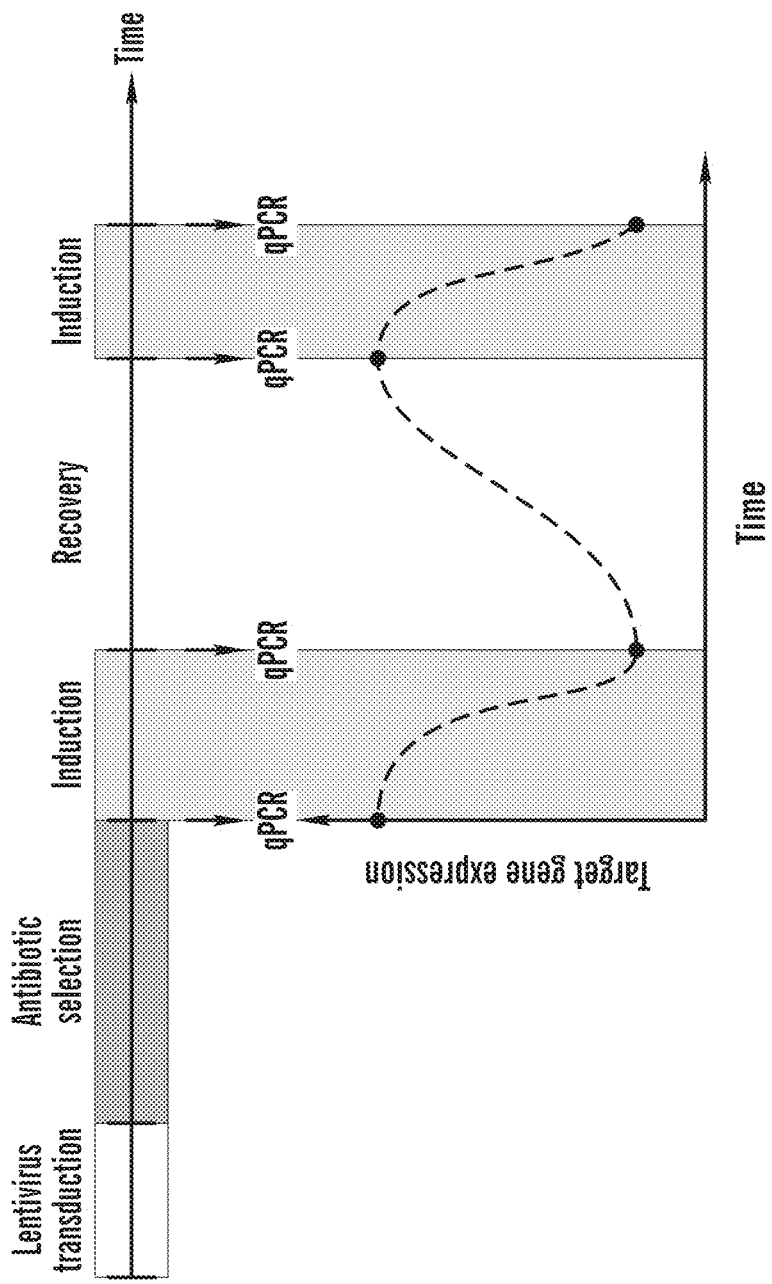
Figure 7E:
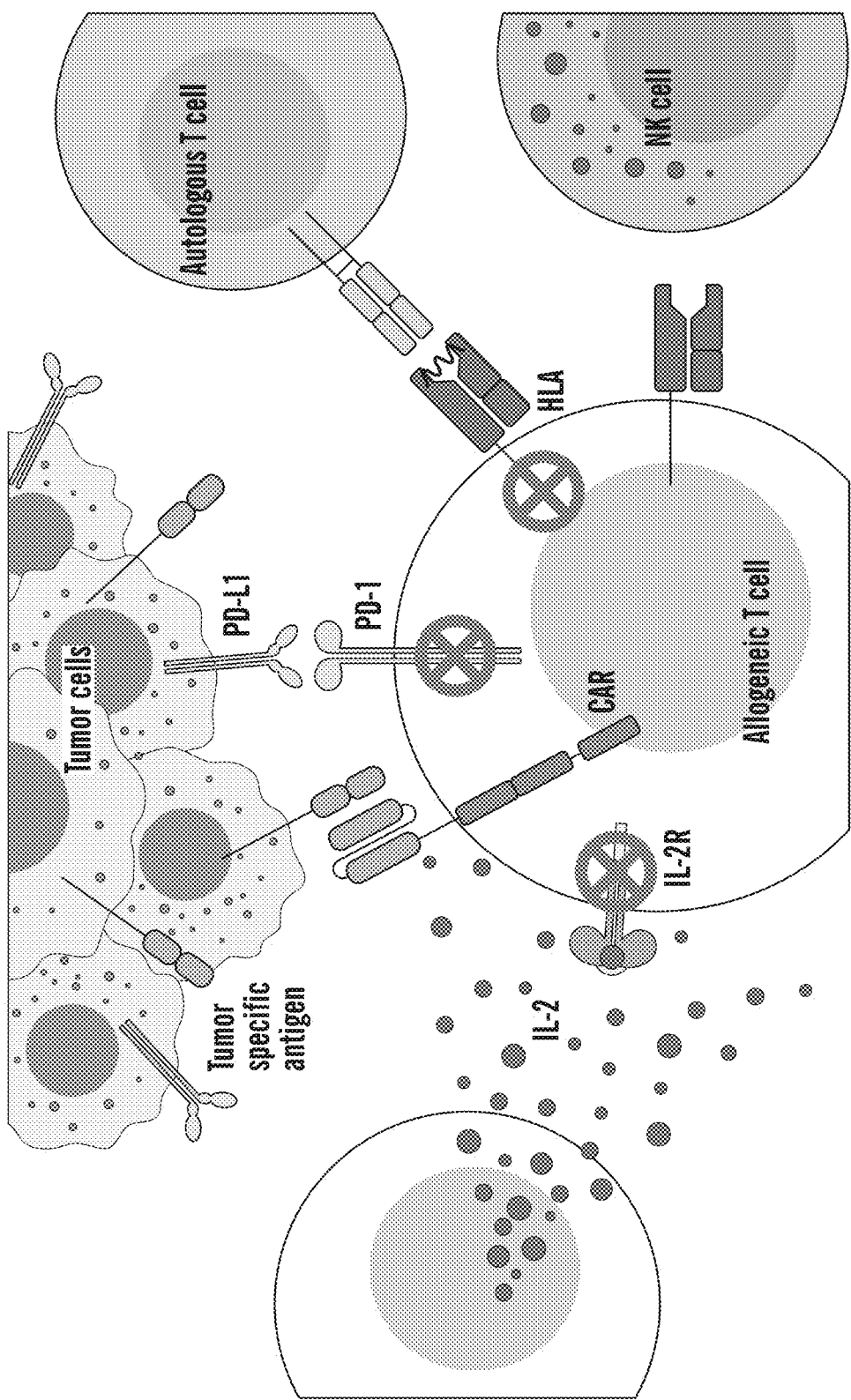

In some embodiments of any of the aspects, the cell comprises an inactivating modification of a T cell transmembrane protein or T cell receptor, e.g., using the polypeptide systems as described herein (see e.g., FIG. 7E). In some embodiments of any of the aspects, the T cell transmembrane protein or T cell receptor is IL-2R, PD-1 and/or HLA. In some embodiments of any of the aspects, the cell comprises an inactivating modification of IL-2R, e.g., using the polypeptide systems as described herein. The interleukin-2 receptor (IL-2R) is a heterotrimeric protein comprising IL-2Rα, IL-2Rβ, and IL-2Rγ expressed on the surface of immune cells, including T cells, that binds and responds to the cytokine IL-2. IL-2 and its receptor have key roles in key functions of the immune system, tolerance and immunity, primarily via their direct effects on T cells. The dual functions of IL-2 in both protective immunity and immune tolerance allows IL-2 to be both an immune stimulant and an immune suppressor, for cancer and autoimmune disease, respectively. The IL-2Rα, IL-2Rβ, and IL-2Rγ proteins in humans are encoded by the L2RA, IL2RB, and IL2RG genes; accordingly, a polypeptide system as described herein can be used to treat cancer by targeting an inactivating modification to at least one of the IL2RA, IL2RB, and/or IL2RG genes.

In some embodiments of any of the aspects, the cell comprises an inactivating modification of PD-1, e.g., using the polypeptide systems as described herein. Programmed cell death protein 1, also known as PD-1 and CD279 (cluster of differentiation 279), is a protein on the surface of T and B cells that has a role in regulating the immune system's response to the cells of the human body by down-regulating the immune system and promoting self-tolerance by suppressing T cell inflammatory activity. PD-1 prevents autoimmune diseases, but it can also prevent the immune system from killing cancer cells. Inhibition of PD-1 thus activates the immune system to attack tumors and can be used to treat cancer. The PD-1 protein in humans is encoded by the PDCD1 gene; accordingly, a polypeptide system as described herein can be used to treat cancer by targeting an inactivating modification to the PDCD1 gene.

In some embodiments of any of the aspects, the cell comprises an inactivating modification of at least one HLA Class I gene in the cell, e.g., using the polypeptide systems as described herein. In some embodiments, an endogenous HLA (e.g., class I and/or class II major histocompatibility complexes) can be edited or removed, e.g., to reduce immunogenicity. In some embodiments, the genetic modification can comprise introduction and expression of non-canonical HLA-G and HLA-E to prevent NK cell-mediated lysis (see e.g., Riolobos L et al. 2013), which can provide a source of universal T cells for immunotherapy, e.g., cancer immune therapy. In some embodiments, the native T cell receptor locus can be removed and/or replaced (e.g., with a CAR polypeptide) to enhance targeted specificity.

Figure 3A:
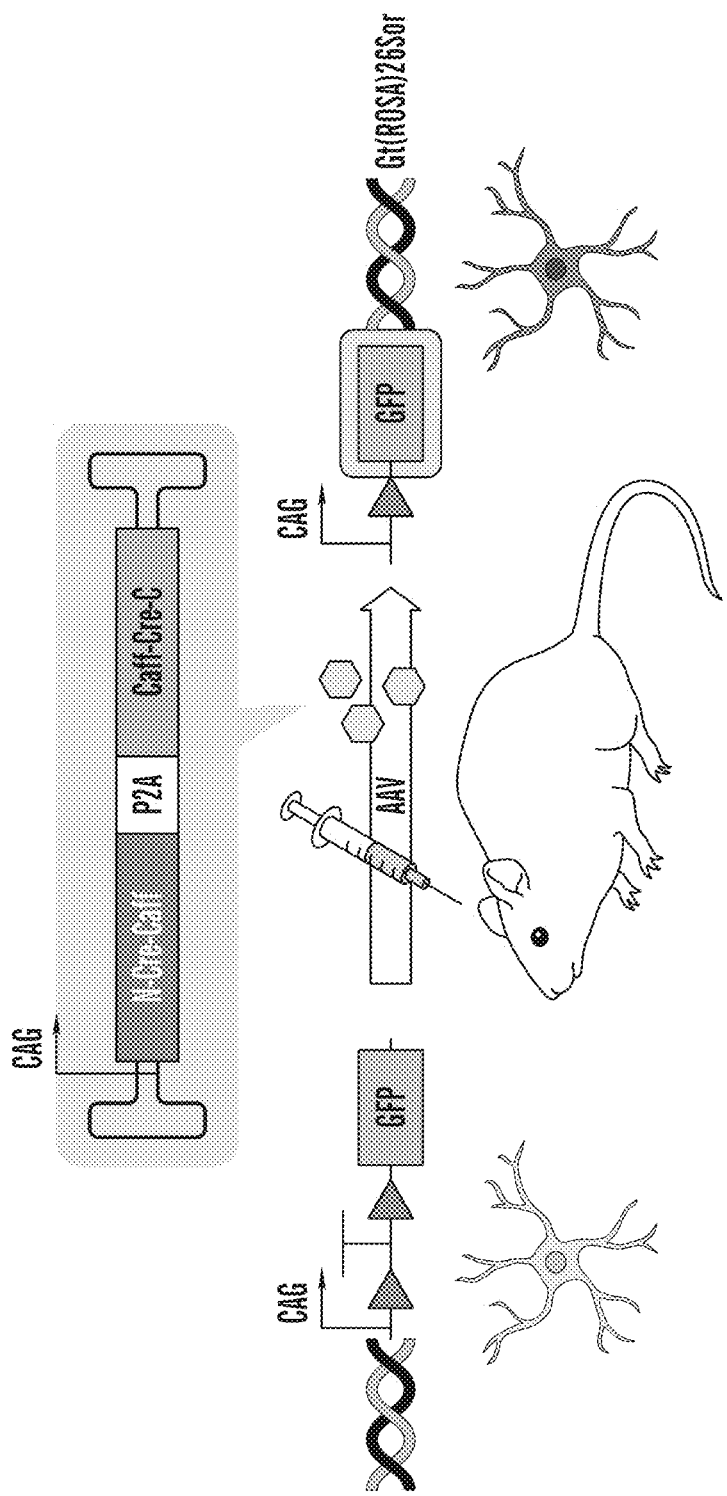
FIG. 3A-3B is a series of schematics.
Figure 3B:
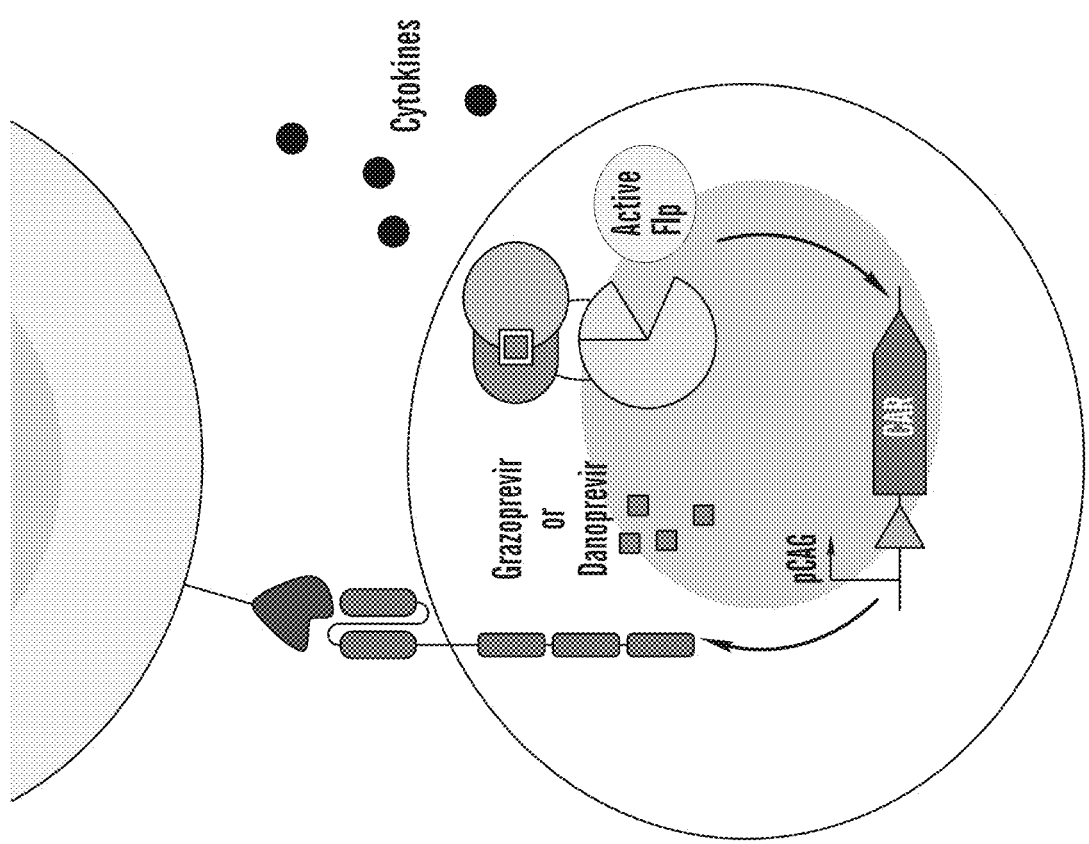
Figure 3B:
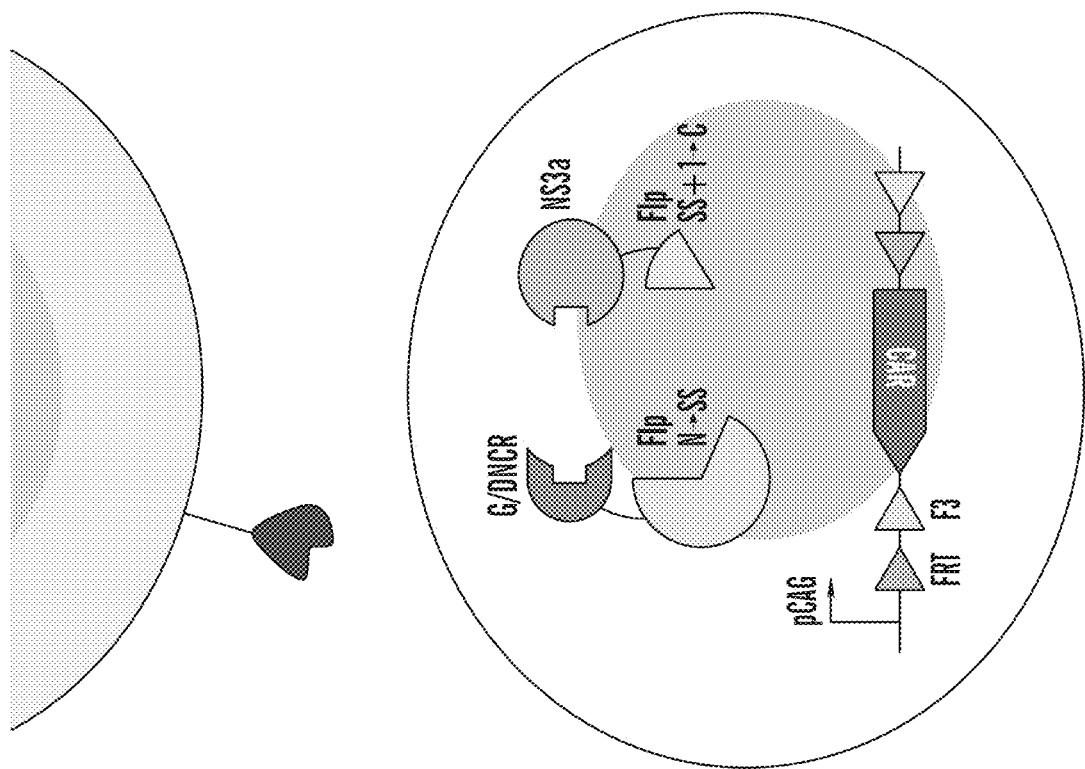

In some embodiments of any of the aspects, the cell is engineered to express a chimeric antigenic receptor (CAR), e.g., using the polypeptide systems as described herein (see e.g., FIG. 3B, FIG. 7E). As a non-limiting example, the cell can further comprise a target nucleic comprising a CAR that is not being expressed. In some embodiments of any of the aspects, the CAR (or another protein of interest) is in a reverse, inexpressible orientation in between recombination recognition sequences. Activation of a split recombinase polypeptide system as described herein allows for recombination of the RRS's and correction of the orientation of the CAR such that it can be expressed (see e.g., FIG. 3B). In some embodiments of any of the aspects, the CAR (or another protein of interest) cannot be expressed to due to an inactivating modification of the CAR gene or the transcriptional or translational control elements of the CAR gene. A split sequence-specific nuclease or split recombinase polypeptide system as described herein can be targeted to remove or otherwise inactivate the inactivating modification of the CAR gene or associated control elements. Thus, activation of the polypeptide system allows for removal of the inactivating modification and expression of the CAR.

Methods of engineering chimeric antigen receptor T cells (also known as CAR T cells) are known in the art. See e.g., U.S. Pat. Nos. 7,446,190, 8,399,645, 8,822,647, 9,212,229, 9,273,283, 9,447,194, 9,587,020, 9,932,405, U.S. Ser. No. 10/125,193, U.S. Ser. No. 10/221,245, U.S. Ser. No. 10/273, 300, U.S. Ser. No. 10/287,354; US patent publication US20160152723; PCT publication WO2009091826, WO2012079000, WO2014165707, WO2015164740, WO2016168595A1, WO2017040945, WO2017100428, WO2017117112, WO2017149515, WO2018067992, WO2018102787, WO2018102786, WO2018165228, WO2019084288; the contents of each of which are incorporated herein by reference in their entireties.

In some embodiments, methods of genetically modifying a cell to express a polypeptide or system described herein can comprise but are not limited to: transfection or electroporation of a cell with a vector encoding a polypeptide or polypeptide system as described herein; transduction with a viral vector (e.g., retrovirus, lentivirus) encoding a polypeptide or polypeptide system as described herein; gene editing using zin finger nucleases (ZFNs), transcription activator-like effector nucleases (TALENs), meganuclease-TALENs, or CRISPR-Cas; or any other methods known in the art of genetically modifying a cell to express a polypeptide or polypeptide system as described herein.

In some embodiments, the methods described herein relate to treating a subject having or diagnosed as having a disease or disorder (e.g., cancer, alloimmunity, autoimmunity, infectious disease, etc.) with a polypeptide or system as described herein. Subjects having such a disease or disorder can be identified by a physician using current methods of diagnosis for cancer, alloimmunity, autoimmunity, or infectious disease. Symptoms and/or complications which characterize these conditions and aid in diagnosis are known in the art. A family history of cancer, alloimmunity, autoimmunity, or infectious disease, or exposure to risk factors for cancer, alloimmunity, autoimmunity, or infectious disease can also aid in determining if a subject is likely to have such a disease or disorder, or in making a diagnosis of cancer, alloimmunity, autoimmunity, or infectious disease.

The compositions described herein can be administered to a subject having or diagnosed as having cancer, alloimmunity, autoimmunity, or infectious disease. In some embodiments, the methods described herein comprise administering an effective amount of compositions described herein, e.g. a polypeptide as described herein to a subject in order to alleviate a symptom of cancer, alloimmunity, autoimmunity, or infectious disease. As used herein, "alleviating a symptom" is ameliorating any condition or symptom associated with the cancer, alloimmunity, autoimmunity, or infectious disease. As compared with an equivalent untreated control, such reduction is by at least 50%, 10%, 20%, 40%, 50%, 60%, 80%, 90%, 95%, 99% or more as measured by any standard technique.

A variety of means for administering the compositions described herein to subjects are known to those of skill in the art. An agent can be administered intravenously by injection or by gradual infusion over time. Given an appropriate formulation for a given route, for example, agents useful in the methods and compositions described herein can be administered intravenously, intranasally, by inhalation, intraperitoneally, intramuscularly, subcutaneously, intracavity, intratumorally, and can be delivered by peristaltic means, if desired, or by other means known by those skilled in the art. In some embodiments of any of the aspects, the compounds used herein are administered orally, intravenously or intramuscularly. Administration can be local or systemic. Local administration, e.g., directly to the site of an organ or tissue transplant is specifically contemplated.

Therapeutic compositions containing at least one agent can be conventionally administered in a unit dose, for example. The term "unit dose" when used in reference to a therapeutic composition refers to physically discrete units suitable as unitary dosage for the subject, each unit containing a predetermined quantity of active material calculated to produce the desired therapeutic effect in association with the required physiologically acceptable diluent, i.e., carrier, or vehicle.

The compositions are administered in a manner compatible with the dosage formulation, and in a therapeutically effective amount. The quantity to be administered and timing depends on the subject to be treated, capacity of the subject's system to utilize the active ingredient, and degree of therapeutic effect desired.

In embodiments where the subject is administered a cell (e.g., expressing a polypeptide or polypeptide system as described herein) and a drug to modulate the activity of the polypeptide system, the cells and drug(s) can be administered together or separately. In embodiments where the subject is separately administered a cell and a drug to modulate the activity of the polypeptide system, each of the compositions can be administered, separately, according to any of the dosages and administration routes/routines described herein.

The term "effective amount" can be used in regard to an inducer agent, repressor agent, guide nucleic acid, ligand for a sequestering domain, or ligand for an inducible promoter; in such embodiments, the term "effective amount" as used herein refers to the amount of an inducer agent, repressor agent, guide nucleic acid, ligand for a sequestering domain, or ligand for an inducible promoter as described herein needed to have a detectable effect on the activity (e.g., inducible dimerization, repressible dimerization, sequestering to a subcellular location, etc.) or expression (e.g., inducible promoter-driven expression) of a polypeptide or polypeptide system as described herein. In some embodiments of any of the aspects, the effective amount of the inducer agent, repressor agent, guide nucleic acid, ligand for a sequestering domain, or ligand for an inducible promoter as described herein is the amount needed to alleviate at least one or more symptom of the disease or disorder, and relates to a sufficient amount of pharmacological composition to provide the desired effect. The term "therapeutically effective amount" therefore refers to an amount of an inducer agent, repressor agent, guide nucleic acid, ligand for a sequestering domain, or ligand for an inducible promoter as described herein that is sufficient to provide a particular anti-disease effect when administered to a typical subject.

The term "effective amount" as used herein in regard to a polypeptide or system refers to the amount of a polypeptide as described herein needed to alleviate at least one or more symptom of the disease or disorder, and relates to a sufficient amount of pharmacological composition to provide the desired effect. The term "therapeutically effective amount" therefore refers to an amount of a polypeptide as described herein that is sufficient to provide a particular anti-disease effect when administered to a typical subject.

An effective amount as used herein, in various contexts, would also include an amount sufficient to delay the development of a symptom of the disease, alter the course of a disease (for example but not limited to, slowing the progression of a symptom of the disease), or reverse a symptom of the disease. Thus, it is not generally practicable to specify an exact "effective amount". However, for any given case, an appropriate "effective amount" can be determined by one of ordinary skill in the art using only routine experimentation.

Effective amounts, toxicity, and therapeutic efficacy can be determined by standard pharmaceutical procedures in cell cultures or experimental animals, e.g., for determining the LD50 (the dose lethal to 50% of the population) and the ED50 (the dose therapeutically effective in 50% of the population). The dosage can vary depending upon the dosage form employed and the route of administration utilized. The dose ratio between toxic and therapeutic effects is the therapeutic index and can be expressed as the ratio LD50/ED50. Compositions and methods that exhibit large therapeutic indices are preferred. A therapeutically effective dose can be estimated initially from cell culture assays. Also, a dose can be formulated in animal models to achieve a circulating plasma concentration range that includes the IC50 (i.e., the concentration of a polypeptide as described herein, which achieves a half-maximal inhibition of symptoms) as determined in cell culture, or in an appropriate animal model. Levels in plasma can be measured, for example, by high performance liquid chromatography. The effects of any particular dosage can be monitored by a suitable bioassay. The dosage can be determined by a physician and adjusted, as necessary, to suit observed effects of the treatment.

Effective amounts, toxicity, and therapeutic efficacy can be determined by standard pharmaceutical procedures in cell cultures or experimental animals, e.g., for determining the minimal effective dose and/or maximal tolerated dose. The dosage can vary depending upon the dosage form employed and the route of administration utilized. A therapeutically effective dose can be estimated initially from cell culture assays. Also, a dose can be formulated in animal models to achieve a dosage range between the minimal effective dose and the maximal tolerated dose. The effects of any particular dosage can be monitored by a suitable bioassay, e.g., assay for tumor growth and/or size among others. The dosage can be determined by a physician and adjusted, as necessary, to suit observed effects of the treatment.

It can generally be stated that a pharmaceutical composition comprising the cells, e.g., immune cells expressing a polypeptide or polypeptide system, described herein may be administered at a dosage of $10^2$ to $10^{10}$ cells/kg body weight, preferably $10^5$ to $10^6$ cells/kg body weight, including all integer values within those ranges. The number of cells can depend upon the ultimate use for which the composition is intended as can the type of cells included therein. For uses provided herein, the cells are generally in a volume of a liter or less, can be 500 mLs or less, even 250 mLs or 100 mLs or less. Hence the density of the desired cells is typically greater than $10^6$ cells/ml and generally is greater than $10^7$ cells/ml, generally $10^8$ cells/ml or greater. The clinically relevant number of immune cells can be apportioned into multiple infusions that cumulatively equal or exceed $10^5$, $10^6$, $10^7$, $10^8$, $10^9$, $10^{10}$, $10^{11}$, or $10^{12}$ cells. In some aspects of the present invention, particularly since all the infused cells can be redirected to a particular target antigen, lower numbers of cells, in the range of $10^6$/kilogram ($10^6$-$10^{11}$ per patient) may be administered. Polypeptide-expressing cell compositions may be administered multiple times at dosages within these ranges. The cells may be allogeneic, syngeneic, xenogeneic, or autologous to the patient undergoing therapy. If desired, the treatment may also include administration of mitogens (e.g., PHA) or lymphokines, cytokines, and/or chemokines (e.g., IFN-γ, IL-2, IL-12, TNF-alpha, IL-18, and TNF-beta, GM-CSF, IL-4, IL-13, Flt3-L, RANTES, MIP1α, etc.) as described herein to enhance induction of the immune response. In some embodiments, the dosage can be from about $1\times10^5$ cells to about $1\times10^8$ cells per kg of body weight. In some embodiments, the dosage can be from about $1\times10^6$ cells to about $1\times10^7$ cells per kg of body weight. In some embodiments, the dosage can be about $1\times10^6$ cells per kg of body weight. In some embodiments, one dose of cells can be administered. In some embodiments, the dose of cells can be repeated, e.g., once, twice, or more. In some embodiments, the dose of cells can be administered on, e.g., a daily, weekly, or monthly basis.

In certain embodiments, an effective dose of a composition comprising a polypeptide as described herein can be administered to a patient once. In certain embodiments, an effective dose of a composition comprising a polypeptide can be administered to a patient repeatedly. For systemic administration, subjects can be administered a therapeutic amount of a composition comprising a polypeptide, such as, e.g. 0.1 mg/kg, 0.5 mg/kg, 1.0 mg/kg, 2.0 mg/kg, 2.5 mg/kg, 5 mg/kg, 10 mg/kg, 15 mg/kg, 20 mg/kg, 25 mg/kg, 30 mg/kg, 40 mg/kg, 50 mg/kg, or more.

In some embodiments, the dose can be from about 2 mg/kg to about 15 mg/kg. In some embodiments, the dose can be about 2 mg/kg. In some embodiments, the dose can be about 4 mg/kg. In some embodiments, the dose can be about 5 mg/kg. In some embodiments, the dose can be about 6 mg/kg. In some embodiments, the dose can be about 8 mg/kg. In some embodiments, the dose can be about 10 mg/kg. In some embodiments, the dose can be about 15 mg/kg. In some embodiments, the dose can be from about 100 mg/m$^2$ to about 700 mg/m$^2$. In some embodiments, the dose can be about 250 mg/m$^2$. In some embodiments, the dose can be about 375 mg/m$^2$. In some embodiments, the dose can be about 400 mg/m$^2$. In some embodiments, the dose can be about 500 mg/m$^2$.

In some embodiments, the dose can be administered intravenously. In some embodiments, the intravenous administration can be an infusion occurring over a period of from about 10 minute to about 3 hours. In some embodiments, the intravenous administration can be an infusion occurring over a period of from about 30 minutes to about 90 minutes.

In some embodiments the dose can be administered about weekly. In some embodiments, the dose can be administered weekly. In some embodiments, the dose can be administered weekly for from about 12 weeks to about 18 weeks. In some embodiments the dose can be administered about every 2 weeks. In some embodiments the dose can be administered about every 3 weeks. In some embodiments, the dose can be from about 2 mg/kg to about 15 mg/kg administered about every 2 weeks. In some embodiments, the dose can be from about 2 mg/kg to about 15 mg/kg administered about every 3 weeks. In some embodiments, the dose can be from about 2 mg/kg to about 15 mg/kg administered intravenously about every 2 weeks. In some embodiments, the dose can be from about 2 mg/kg to about 15 mg/kg administered intravenously about every 3 weeks. In some embodiments, the dose can be from about 200 mg/m2 to about 400 mg/m2 administered intravenously about every week. In some embodiments, the dose can be from about 200 mg/m2 to about 400 mg/m2 administered intravenously about every 2 weeks. In some embodiments, the dose can be from about 200 mg/m2 to about 400 mg/m2 administered intravenously about every 3 weeks. In some embodiments, a total of from about 2 to about 10 doses are administered. In some embodiments, a total of 4 doses are administered. In some embodiments, a total of 5 doses are administered. In some embodiments, a total of 6 doses are administered. In some embodiments, a total of 7 doses are administered. In some embodiments, a total of 8 doses are administered. In some embodiments, the administration occurs for a total of from about 4 weeks to about 12 weeks. In some embodiments, the administration occurs for a total of about 6 weeks. In some embodiments, the administration occurs for a total of about 8 weeks. In some embodiments, the administration occurs for a total of about 12 weeks. In some embodiments, the initial dose can be from about 1.5 to about 2.5 fold greater than subsequent doses.

In some embodiments, the dose can be from about 1 mg to about 2000 mg. In some embodiments, the dose can be about 3 mg. In some embodiments, the dose can be about 10 mg. In some embodiments, the dose can be about 30 mg. In some embodiments, the dose can be about 1000 mg. In some embodiments, the dose can be about 2000 mg. In some embodiments, the dose can be about 3 mg given by intravenous infusion daily. In some embodiments, the dose can be about 10 mg given by intravenous infusion daily. In some embodiments, the dose can be about 30 mg given by intravenous infusion three times per week.

In some embodiments, after an initial treatment regimen, the treatments can be administered on a less frequent basis. For example, after treatment biweekly for three months, treatment can be repeated once per month, for six months or a year or longer. Treatment according to the methods described herein can reduce levels of a marker or symptom of a condition, e.g. by at least 10%, at least 15%, at least 20%, at least 25%, at least 30%, at least 40%, at least 50%, at least 60%, at least 70%, at least 80% or at least 90% or more.

The dosage of a composition as described herein can be determined by a physician and adjusted, as necessary, to suit observed effects of the treatment. With respect to duration and frequency of treatment, it is typical for skilled clinicians to monitor subjects in order to determine when the treatment is providing therapeutic benefit, and to determine whether to increase or decrease dosage, increase or decrease administration frequency, discontinue treatment, resume treatment, or make other alterations to the treatment regimen. The dosing schedule can vary from once a week to daily depending on a number of clinical factors, such as the subject's sensitivity to the polypeptide or polypeptide system. The desired dose or amount can be administered at one time or divided into subdoses, e.g., 2-4 subdoses and administered over a period of time, e.g., at appropriate intervals through the day or other appropriate schedule. In some embodiments, administration can be chronic, e.g., one or more doses and/or treatments daily over a period of weeks or months. Examples of dosing and/or treatment schedules are administration daily, twice daily, three times daily or four or more times daily over a period of 1 week, 2 weeks, 3 weeks, 4 weeks, 1 month, 2 months, 3 months, 4 months, 5 months, or 6 months, or more. A composition as described herein can be administered over a period of time, such as over a 5 minute, 10 minute, 15 minute, 20 minute, or 25 minute period.

The dosage ranges for the administration of a composition comprising a polypeptide or polypeptide system, according to the methods described herein depend upon, for example, the form of the composition, its potency, and the extent to which symptoms, markers, or indicators of a condition described herein are desired to be reduced, for example the percentage reduction desired for the disease or disorder (e.g., cancer). The dosage should not be so large as to cause adverse side effects, such as autoimmunity. Generally, the dosage can vary with the age, condition, and sex of the patient and can be determined by one of skill in the art. The dosage can also be adjusted by the individual physician in the event of any complication.

The efficacy of a composition in, e.g. the treatment of a condition described herein can be determined by the skilled clinician. However, a treatment is considered "effective treatment," as the term is used herein, if one or more of the signs or symptoms of a condition described herein are altered in a beneficial manner, other clinically accepted symptoms are improved, or even ameliorated, or a desired response is induced e.g., by at least 10% following treatment according to the methods described herein. Efficacy can be assessed, for example, by measuring a marker, indicator, symptom, and/or the incidence of a condition treated according to the methods described herein or any other measurable parameter appropriate, e.g. tumor size. Efficacy can also be measured by a failure of an individual to worsen as assessed by hospitalization, or need for medical interventions (i.e., progression of the disease is halted). Methods of measuring these indicators are known to those of skill in the art and/or are described herein. Treatment includes any treatment of a disease in an individual or an animal (some non-limiting examples include a human or an animal) and includes: (1) inhibiting the disease, e.g., preventing a worsening of symptoms (e.g. pain or inflammation); or (2) relieving the severity of the disease, e.g., causing regression of symptoms. An effective amount for the treatment of a disease means that amount which, when administered to a subject in need thereof, is sufficient to result in effective treatment as that term is defined herein, for that disease. Efficacy of an agent can be determined by assessing physical indicators of a condition or desired response, (e.g. tumor size). It is well within the ability of one skilled in the art to monitor efficacy of administration and/or treatment by measuring any one of such parameters, or any combination of parameters. Efficacy can be assessed in animal models of a condition described herein, for example treatment of cancer. When using an experimental animal model, efficacy of treatment is evidenced when a statistically significant change in a marker is observed, e.g. tumor size.

In vitro and animal model assays are provided herein which allow the assessment of a given dose of a composition. The efficacy of a given dosage combination can also be assessed in an animal model, e.g. a specific cancer animal model.

In one aspect, described herein is a pharmaceutical composition comprising the at least one polypeptide, system, polynucleotide, vector, or cell as described herein, which are collectively referred to as a composition (see e.g., Tables 18-26, 29-33). In some embodiments of any of the aspects, the pharmaceutical composition can comprise any combination of polypeptides or systems (see e.g., Table 17). In some embodiments of any of the aspects, the pharmaceutical composition can further comprise an inducer agent, repressor agent, guide nucleic acid, ligand for a sequestering domain, or inducer for an inducible promoter, as described herein.

In some embodiments, the technology described herein relates to a pharmaceutical composition comprising a composition as described herein, and optionally a pharmaceutically acceptable carrier. In some embodiments, the active ingredients of the pharmaceutical composition comprise the polypeptide, the system, the protease inhibitor, inducer agent, repressor agent, guide nucleic acid, ligand for a sequestering domain, and/or inducer for an inducible promoter as described herein. In some embodiments, the active ingredients of the pharmaceutical composition consist essentially of the polypeptide, the system, the protease inhibitor, inducer agent, repressor agent, guide nucleic acid, ligand for a sequestering domain, and/or inducer for an inducible promoter as described herein. In some embodiments, the active ingredients of the pharmaceutical composition consist of the polypeptide, the system, the protease inhibitor, inducer agent, repressor agent, guide nucleic acid, ligand for a sequestering domain, and/or inducer for an inducible promoter as described herein.

Pharmaceutically acceptable carriers and diluents include saline, aqueous buffer solutions, solvents and/or dispersion media. The use of such carriers and diluents is well known in the art. Some non-limiting examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids; (23) serum component, such as serum albumin, HDL and LDL; (24) $C_2$-$C_{12}$ alcohols, such as ethanol; and (25) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein. In some embodiments, the carrier inhibits the degradation of the active agent, e.g. the polypeptide, the system, the protease inhibitor, inducer agent, repressor agent, guide nucleic acid, ligand for a sequestering domain, and/or inducer for an inducible promoter as described herein.

In some embodiments, the pharmaceutical composition comprising a composition as described herein can be a parenteral dose form. Since administration of parenteral dosage forms typically bypasses the patient's natural defenses against contaminants, parenteral dosage forms are preferably sterile or capable of being sterilized prior to administration to a patient. Examples of parenteral dosage forms include, but are not limited to, solutions ready for injection, dry products ready to be dissolved or suspended in a pharmaceutically acceptable vehicle for injection, suspensions ready for injection, and emulsions. In addition, controlled-release parenteral dosage forms can be prepared for administration of a patient, including, but not limited to, DUROS®-type dosage forms and dose-dumping.

Suitable vehicles that can be used to provide parenteral dosage forms of compositions as disclosed within are well known to those skilled in the art. Examples include, without limitation: sterile water; water for injection USP; saline solution; glucose solution; aqueous vehicles such as but not limited to, sodium chloride injection, Ringer's injection, dextrose Injection, dextrose and sodium chloride injection, and lactated Ringer's injection; water-miscible vehicles such as, but not limited to, ethyl alcohol, polyethylene glycol, and propylene glycol; and non-aqueous vehicles such as, but not limited to, corn oil, cottonseed oil, peanut oil, sesame oil, ethyl oleate, isopropyl myristate, and benzyl benzoate.

Pharmaceutical compositions can also be formulated to be suitable for oral administration, for example as discrete dosage forms, such as, but not limited to, tablets (including without limitation scored or coated tablets), pills, caplets, capsules, chewable tablets, powder packets, cachets, troches, wafers, aerosol sprays, or liquids, such as but not limited to, syrups, elixirs, solutions or suspensions in an aqueous liquid, a non-aqueous liquid, an oil-in-water emulsion, or a water-in-oil emulsion. Such compositions contain a predetermined amount of the pharmaceutically acceptable salt of the disclosed compounds, and may be prepared by methods of pharmacy well known to those skilled in the art. See generally, Remington: The Science and Practice of Pharmacy, 21st Ed., Lippincott, Williams, and Wilkins, Philadelphia Pa. (2005).

Conventional dosage forms generally provide rapid or immediate drug release from the formulation. Depending on the pharmacology and pharmacokinetics of the drug, use of conventional dosage forms can lead to wide fluctuations in the concentrations of the drug in a patient's blood and other tissues. These fluctuations can impact a number of parameters, such as dose frequency, onset of action, duration of efficacy, maintenance of therapeutic blood levels, toxicity, side effects, and the like. Advantageously, controlled-release formulations can be used to control a drug's onset of action, duration of action, plasma levels within the therapeutic window, and peak blood levels. In particular, controlled- or extended-release dosage forms or formulations can be used to ensure that the maximum effectiveness of a drug is achieved while minimizing potential adverse effects and safety concerns, which can occur both from under-dosing a drug (i.e., going below the minimum therapeutic levels) as well as exceeding the toxicity level for the drug. In some embodiments, the composition can be administered in a sustained release formulation.

Controlled-release pharmaceutical products have a common goal of improving drug therapy over that achieved by their non-controlled release counterparts. Ideally, the use of an optimally designed controlled-release preparation in medical treatment is characterized by a minimum of drug substance being employed to cure or control the condition in a minimum amount of time. Advantages of controlled-release formulations include: 1) extended activity of the drug; 2) reduced dosage frequency; 3) increased patient compliance; 4) usage of less total drug; 5) reduction in local or systemic side effects; 6) minimization of drug accumulation; 7) reduction in blood level fluctuations; 8) improvement in efficacy of treatment; 9) reduction of potentiation or loss of drug activity; and 10) improvement in speed of control of diseases or conditions. Kim, Chemg-ju, Controlled Release Dosage Form Design, 2 (Technomic Publishing, Lancaster, Pa.: 2000).

Most controlled-release formulations are designed to initially release an amount of drug (active ingredient) that promptly produces the desired therapeutic effect, and gradually and continually release other amounts of drug to maintain this level of therapeutic or prophylactic effect over an extended period of time. In order to maintain this constant level of drug in the body, the drug must be released from the dosage form at a rate that can replace the amount of drug being metabolized and excreted from the body. Controlled-release of an active ingredient can be stimulated by various conditions including, but not limited to, pH, ionic strength, osmotic pressure, temperature, enzymes, water, and other physiological conditions or compounds.

A variety of known controlled- or extended-release dosage forms, formulations, and devices can be adapted for use with the salts and compositions of the disclosure. Examples include, but are not limited to, those described in U.S. Pat. Nos. 3,845,770; 3,916,899; 3,536,809; 3,598,123; 4,008,719; 5,674,533; 5,059,595; 5,591,767; 5,120,548; 5,073,543; 5,639,476; 5,354,556; 5,733,566; and 6,365,185 B1; each of which is incorporated herein by reference. These dosage forms can be used to provide slow or controlled-release of one or more active ingredients using, for example, hydroxypropylmethyl cellulose, other polymer matrices, gels, permeable membranes, osmotic systems (such as OROS® (Alza Corporation, Mountain View, Calif. USA)), or a combination thereof to provide the desired release profile in varying proportions.

In some embodiments of any of the aspects, the composition described herein is administered as a monotherapy, e.g., another treatment for the disease or disorder (e.g., cancer) is not administered to the subject.

In some embodiments of any of the aspects, the methods described herein can further comprise administering a second agent and/or treatment to the subject, e.g. as part of a combinatorial therapy. Non-limiting examples of a second agent and/or treatment can include radiation therapy, surgery, gemcitabine, cisplatin, paclitaxel, carboplatin, bortezomib, AMG479, vorinostat, rituximab, temozolomide, rapamycin, ABT-737, PI-103; alkylating agents such as thiotepa and CYTOXAN® cyclophosphamide; alkyl sulfonates such as busulfan, improsulfan and piposulfan; aziridines such as benzodopa, carboquone, meturedopa, and uredopa; ethylenimines and methylmelamines including altretamine, triethylenemelamine, trietylenephosphoramide, triethylenethiophosphoramide and trimethylol melamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosoureas such as carmustine, chlorozotocin, fotemustine, lomustine, nimustine, and ranimustine; antibiotics such as the enediyne antibiotics (e.g., calicheamicin, especially calicheamicin gamma1I and calicheamicin omega1I (see, e.g., Agnew, Chem. Intl. Ed. Engl., 33: 183-186 (1994)); dynemicin, including dynemicin A;

bisphosphonates, such as clodronate; an esperamicin; as well as neocarzinostatin chromophore and related chromoprotein enediyne antibiotic chromophores), aclacinomycins, actinomycin, authramycin, azaserine, bleomycins, cactinomycin, carabicin, caminomycin, carzinophilin, chromomycins, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idanibicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elformithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofuran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE® Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin, oxaliplatin and carboplatin; vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; irinotecan (Camptosar, CPT-11) (including the treatment regimen of irinotecan with 5-FU and leucovorin); topoisomerase inhibitor RFS 2000; difluoromethylomithine (DMFO); retinoids such as retinoic acid; capecitabine; combretastatin; leucovorin (LV); oxaliplatin, including the oxaliplatin treatment regimen (FOLFOX); lapatinib (Tykerb®); inhibitors of PKC-alpha, Raf, H-Ras, EGFR (e.g., erlotinib (Tarceva®)) and VEGF-A that reduce cell proliferation and pharmaceutically acceptable salts, acids or derivatives of any of the above.

In addition, the methods of treatment can further include the use of radiation or radiation therapy. Further, the methods of treatment can further include the use of surgical treatments.

The compositions described herein can be administered to a subject in need thereof. In multiple aspects, described herein are methods of modulating the expression of a target polypeptide or methods of treating a subject using a polypeptide system as described herein. In general, the compositions can be administered to any subject in need of a cell therapy; the polypeptides and polypeptide systems described herein allow for fine-tuned control of expression of a target gene. In some embodiments of any of the aspects, the compositions described herein can be administered for the treatment of cancer, autoimmunity, alloimmunity, or infectious disease, e.g., the polypeptides and polypeptide systems described herein allow for fine-tuned control of expression of a target gene that can be used to treat cancer, autoimmunity, alloimmunity, or infectious disease.

In some embodiments of any of the aspects, the compositions described herein can be administered for the treatment of a disease or disorder selected from the group consisting of: cancer; autoimmunity; alloimmunity; infectious disease; aging; diseases or disorders associated with DNA damage; a hypertrophic scar; age-related macular degeneration; Alport syndrome; or neuropathy In some embodiments of any of the aspects, the compositions described herein can be administered for the treatment of aging or age-associated diseases or disorders. In some embodiments of any of the aspects, the compositions described herein can be administered for the treatment of DNA damage. In some embodiments of any of the aspects, the compositions described herein can be administered as part of a gene therapy. In some embodiments of any of the aspects, the compositions described herein can be administered for the treatment of a hypertrophic scar. A hypertrophic scar is a thick, raised scar exhibiting an abnormal response to wound healing. In some embodiments of any of the aspects, the compositions described herein can be administered for the treatment of age-related macular degeneration. In some embodiments of any of the aspects, the compositions described herein can be administered for the treatment of Alport syndrome. Alport syndrome is a disease that damages the tiny blood vessels in the kidneys; it can lead to kidney disease and kidney failure, and it can also cause hearing loss and problems within the eyes. In some embodiments of any of the aspects, the compositions described herein can be administered for the treatment of a neuropathy. Neuropathy is a disease or dysfunction of one or more peripheral nerves, typically causing numbness or weakness.

In some embodiments of any of the aspects, the polypeptide systems as described herein are used to inactivate expression of a T cell transmembrane protein or T cell receptor, e.g., IL-2R, PD-1 and/or HLA, and/or to activate expression of a CAR or another gene of interest in the cells of a subject in order to treat a disease or disorder as described herein (see e.g., FIG. 3B, FIG. 7E).

In some embodiments of any of the aspects, the methods as described herein are reversible, e.g., upon removal of the inducer agent, inducer signal, repressor agent, repressor signal, guide nucleic acid, ligand for the sequestering domain, and/or ligand for the inducible promoter. In some embodiments of any of the aspects, the methods as described herein are not reversible, e.g., if the methods result in an irreversible alteration of the genome.

Autoimmunity is the system of immune responses of an organism against its own healthy cells and tissues. Any disease that results from such an aberrant immune response is termed an "autoimmune disease". Alloimmunity (sometimes called isoimmunity) is an immune response to non-self antigens from members of the same species, which are called alloantigens or isoantigens. Two major types of alloantigens are blood group antigens and histocompatibility antigens. Infectious diseases that can be treated with the compositions described herein include any microorganism with a specific microbial antigen that can be targeted; the infectious diseases can be viral (e.g., HIV), bacterial, or fungal infections.

In some embodiments, the method of treatment can comprise first diagnosing a subject or patient who can benefit from treatment by a composition described herein. In some embodiments, such diagnosis comprises detecting or measuring an abnormal level of a marker (e.g., tumor antigens) in a sample from the subject or patient. In some embodiments, the method further comprises administering to the patient a composition as described herein.

In some embodiments, the subject has previously been determined to have an abnormal level of an analyte described herein relative to a reference. In some embodiments, the reference level can be the level in a sample of similar cell type, sample type, sample processing, and/or obtained from a subject of similar age, sex and other demographic parameters as the sample/subject. In some embodiments, the test sample and control reference sample are of the same type, that is, obtained from the same biological source, and comprising the same composition, e.g. the same number and type of cells.

The term "sample" or "test sample" as used herein denotes a sample taken or isolated from a biological organism, e.g., a blood or plasma sample from a subject. In some embodiments of any of the aspects, the technology described herein encompasses several examples of a biological sample. In some embodiments of any of the aspects, the biological sample is cells, or tissue, or peripheral blood, or bodily fluid. Exemplary biological samples include, but are not limited to, a biopsy, a tumor sample, biofluid sample; blood; serum; plasma; urine; sperm; mucus; tissue biopsy; organ biopsy; synovial fluid; bile fluid; cerebrospinal fluid; mucosal secretion; effusion; sweat; saliva; and/or tissue sample etc. The term also includes a mixture of the above-mentioned samples. The term "test sample" also includes untreated or pretreated (or pre-processed) biological samples. In some embodiments of any of the aspects, a test sample can comprise cells from a subject.

In some embodiments of any of the aspects, the step of determining if the subject has an abnormal level of an analyte described herein can comprise i) obtaining or having obtained a sample from the subject and ii) performing or having performed an assay on the sample obtained from the subject to determine/measure the level of the analyte in the subject. In some embodiments of any of the aspects, the step of determining if the subject has an abnormal level of an analyte described herein can comprise performing or having performed an assay on a sample obtained from the subject to determine/measure the level of analyte in the subject. In some embodiments of any of the aspects, the step of determining if the subject has an abnormal level of an analyte described herein can comprise ordering or requesting an assay on a sample obtained from the subject to determine/measure the level of the analyte in the subject. In some embodiments of any of the aspects, the step of determining if the subject has an abnormal level of an analyte described herein can comprise receiving the results of an assay on a sample obtained from the subject to determine/measure the level of the analyte in the subject. In some embodiments of any of the aspects, the step of determining if the subject has an abnormal level of an analyte described herein can comprise receiving a report, results, or other means of identifying the subject as a subject with a decreased level of the analyte.

In one aspect of any of the embodiments, described herein is a method of treating cancer (or another disease or disorder as described herein) in a subject in need thereof, the method comprising: a) determining if the subject has an abnormal level of an analyte described herein; and b) instructing or directing that the subject be administered a composition as described herein if the level of the analyte is increased or otherwise abnormal relative to a reference. In some embodiments of any of the aspects, the step of instructing or directing that the subject be administered a particular treatment can comprise providing a report of the assay results. In some embodiments of any of the aspects, the step of instructing or directing that the subject be administered a particular treatment can comprise providing a report of the assay results and/or treatment recommendations in view of the assay results.

In multiple aspects described herein are methods of modulating the expression of a target polypeptide in a population of cells or methods of detecting a target nucleic acid in a population of cells. In some embodiments of any of the aspects, such methods can be carried out in cell-free system. Such a cell-free system comprising the machinery for mRNA transcription and/or protein translation. Such a cell-free system is at the proper conditions (e.g., temperature, pH, salinity, etc.) to allow for the reactions described herein (e.g., recombination, nuclease activity, hybridization, etc.). For example, subcellular fractions can be isolated by ultracentrifugation to provide molecular machinery that can be used in reactions in the absence of many of the other cellular components. See e.g., Laohakunakom, Cell-Free Systems: A Proving Ground for Rational Biodesign, Front. Bioeng. Biotechnol 2020, the content of which are incorporated herein by reference in its entirety.

In multiple aspects, described herein are methods of modulating the expression of a target polypeptide or methods of treating a subject using an inducible dimerization system as described herein. In one aspect, described herein is a method of modulating the expression of a target polypeptide, comprising: (a) providing a population of cells comprising a polypeptide system as described herein (e.g., an inducible dimerization system); and (b) contacting the cells with an inducer agent or inducer signal for the inducible dimerization domain of the polypeptide system.

In some embodiments of any of the aspects, the method further comprises contacting the cells with a target nucleic acid encoding the target polypeptide. In some embodiments of any of the aspects, the target nucleic acid comprises recombination sites specifically bound and cleaved by the active recombinase of the polypeptide system. In some embodiments of any of the aspects, the target nucleic acid comprises sites specifically bound and cleaved by the active sequence-specific nuclease of the polypeptide system. In some embodiments of any of the aspects, the target nucleic acid encodes a CAR polypeptide or an immune cell receptor (e.g., HLA, IL-2R, PD-1). In some embodiments of any of the aspects, the method further comprises contacting the cells with a guide nucleic acid for the active sequence-specific nuclease. In some embodiments of any of the aspects, the guide nucleic acid is substantially complementary to a portion of a CAR polypeptide or an immune cell receptor (e.g., HLA, IL-2R, PD-1) or a promoter or expression unit associated with a CAR polypeptide or an immune cell receptor.

In one aspect, described herein is a method of treating a subject in need of a cell-based therapy, comprising: (a) administering to the subject a population of cells comprising a polypeptide system as described herein (e.g., an inducible dimerization system); and (b) administering to the subject an effective amount of the inducer agent or inducer signal for the inducible dimerization domain.

In some embodiments of any of the aspects, the method further comprises administering a target nucleic acid encoding the target polypeptide, wherein the target nucleic acid comprises recombination sites specifically bound and cleaved by the active recombinase of the polypeptide system. In some embodiments of any of the aspects, the method further comprises administering a target nucleic acid encoding the target polypeptide, wherein the target nucleic acid comprises sites specifically bound and cleaved by the active sequence-specific nuclease of the polypeptide system. In some embodiments of any of the aspects, the method further comprises administering a guide nucleic acid for the active sequence-specific nuclease.

In some embodiments of any of the aspects, in the presence of the inducer agent or inducer signal for the inducible dimerization domain, the recombinase or sequence-specific nuclease is active. In some embodiments of any of the aspects, in the absence of the inducer agent or inducer signal for the inducible dimerization domain, the recombinase or sequence-specific nuclease is inactive. In some embodiments of any of the aspects, the inducer agent is selected from the group consisting of: caffeine, abscisic acid, rapalog, gibberellin, and a protease inhibitor (e.g., grazoprevir, danoprevir). In some embodiments of any of the aspects, the inducer signal is light (e.g., blue light, pulsed light).

In some embodiments of any of the aspects, the expression of the target polypeptide is increased when the active recombinase or active sequence-specific nuclease cleaves a portion of the target polynucleotide that inhibits expression of the target polypeptide. As a non-limiting example, the active recombinase cleaves a pair of RRS's surrounding the nucleotide encoding the target polypeptide in the reverse orientation and recombines the nucleotide such that the target polypeptide is in an expressible orientation (see e.g., FIG. 3B). In some embodiments of any of the aspects, the target polypeptide cannot be expressed to due to an inactivating modification of the nucleotide encoding the target polypeptide or the transcriptional or translational control elements of the target polypeptide. A split sequence-specific nuclease or split recombinase polypeptide system as described herein can be targeted to remove or otherwise inactivate the inactivating modification of the nucleotide encoding the target polypeptide or associated control elements.

In some embodiments of any of the aspects, the expression of the target polypeptide is decreased when the active recombinase or active sequence-specific nuclease cleaves a portion of the target polynucleotide that induces expression of the target polypeptide or a portion of the target polynucleotide that encodes for the target polypeptide. As a non-limiting example, the active recombinase or active sequence-specific nuclease cleaves a coding region of the nucleotide encoding the target polypeptide such that it can no longer be expressed. As another non-limiting example, the active recombinase or active sequence-specific nuclease cleaves a promoter or another transcriptional control unit for the nucleotide encoding the target polypeptide such that the polypeptide can no longer be expressed.

In one aspect described herein is a method of modulating the expression of a target polypeptide, comprising: (a) providing a population of cells comprising a polypeptide system as described herein (e.g., a repressible dimerization system); and contacting the cells with a repressor agent or repressor signal for the repressible dimerization domain of the polypeptide system.

In some embodiments of any of the aspects, the method further comprises contacting the cells with a target nucleic acid encoding the target polypeptide, wherein the target nucleic acid comprises recombination sites specifically bound and cleaved by the active recombinase of the polypeptide system. In some embodiments of any of the aspects, the method further comprises contacting the cells with a target nucleic acid encoding the target polypeptide, wherein the target nucleic acid comprises sites specifically bound and cleaved by the active sequence-specific nuclease of the polypeptide system. In some embodiments of any of the aspects, the method further comprises contacting the cells with a guide nucleic acid for the active sequence-specific nuclease.

In one aspect described herein is a method of treating a subject in need of a cell-based therapy, comprising: (a) administering to the subject a population of cells comprising a polypeptide system as described herein (e.g., a repressible dimerization system); and (b) administering to the subject an effective amount of the repressor agent or repressor signal for the repressible dimerization domain.

In some embodiments of any of the aspects, the method further comprises administering a target nucleic acid encoding the target polypeptide, wherein the target nucleic acid comprises recombination sites specifically bound and cleaved by the active recombinase of the polypeptide system. In some embodiments of any of the aspects, the method further comprises administering a target nucleic acid encoding the target polypeptide, wherein the target nucleic acid comprises sites specifically bound and cleaved by the active sequence-specific nuclease of the polypeptide system. In some embodiments of any of the aspects, the method further comprises administering a guide nucleic acid for the active sequence-specific nuclease.

In some embodiments of any of the aspects, in the presence of the repressor agent or repressor signal for the repressible dimerization domain, the recombinase or sequence-specific nuclease is inactive. In some embodiments of any of the aspects, in the absence of the repressor agent or repressor signal for the repressible dimerization domain, the recombinase or sequence-specific nuclease is active. In some embodiments of any of the aspects, the repressor agent or signal is a protease inhibitor (e.g., grazoprevir, danoprevir).

In some embodiments of any of the aspects, the expression of the target polypeptide is increased when the active recombinase or active sequence-specific nuclease cleaves a portion of the target polynucleotide that inhibits expression of the target polypeptide. In some embodiments of any of the aspects, the expression of the target polypeptide is decreased when the active recombinase or active sequence-specific nuclease cleaves a portion of the target polynucleotide that induces expression of the target polypeptide or a portion of the target polynucleotide that encodes for the target polypeptide.

In one aspect described herein is a method of modulating the expression of a target polypeptide, comprising: (a) providing a population of cells comprising a polypeptide system as described herein (e.g., inducible nuclease split-recombinase system); and (b) contacting the cells with the guide nucleic acids for the sequence-specific nucleases of the polypeptide system. In some embodiments of any of the aspects, the method further comprises contacting the cells with the first and second target nucleic acids for the sequence-specific nucleases of the polypeptide system. In some embodiments of any of the aspects, the method further comprises contacting the cells with a third target nucleic acid encoding the target polypeptide. In some embodiments of any of the aspects, the target nucleic acid comprises recombination sites specifically bound and cleaved by the active recombinase of the polypeptide system.

In one aspect described herein is a method of treating a subject in need of a cell-based therapy, comprising: (a) administering to the subject a population of cells comprising a polypeptide system as described herein (e.g., inducible nuclease split-recombinase system); and (b) administering to the subject an effective amount of the guide nucleic acids for the sequence-specific nucleases of the polypeptide system. In some embodiments of any of the aspects, the method further comprises administering the first and second target nucleic acids for the sequence-specific nucleases of the polypeptide system. In some embodiments of any of the aspects, the method further comprises administering a third target nucleic acid encoding the target polypeptide, wherein the target nucleic acid comprises recombination sites specifically bound and cleaved by the active recombinase of the polypeptide system.

In some embodiments of any of the aspects, in the presence of the guide nucleic acids and first and second target nucleic acids, the recombinase is active. In some embodiments of any of the aspects, in the absence of the guide nucleic acids or first and second target nucleic acids, the recombinase is inactive. In some embodiments of any of the aspects, the expression of the target polypeptide is increased when the active recombinase cleaves a portion of the target polynucleotide that inhibits expression of the target polypeptide. In some embodiments of any of the aspects, the expression of the target polypeptide is decreased when the active recombinase cleaves a portion of the target polynucleotide that induces expression of the target polypeptide or a portion of the target polynucleotide that encodes for the target polypeptide.

In some embodiments of any of the aspects, the first and second target nucleic acids are comprised by the same nucleic acid molecule, and the system is used to detect the presence and/or expression levels of this nucleic acid molecule. In some embodiments of any of the aspects, the third target nucleic acid encodes for a detectable marker (see e.g., FIG. 25).

Accordingly, in one aspect described herein is a method of detecting a target nucleic acid, comprising: (a) providing a population of cells comprising a polypeptide system as described herein (e.g., inducible nuclease split-recombinase system); (b) contacting the cells with: (i) the guide nucleic acids for the sequence-specific nucleases of the polypeptide system; and (ii) a detection nucleic acid comprising: (1) at least one recombinase recognition sequence (RRS) as described herein; and (2) the coding sequence for a detectable marker; (c) detecting the detectable marker; and (d) determining that the target nucleic acid is present in the cell if the detectable marker is detected, or determining that the target nucleic acid is not present in the cell if the detectable marker is not detected. In some embodiments of any of the aspects, the first and second sequence-specific nuclease ($N^A$ and $N^B$) in combination with their guide nucleic acids specifically bind to the target nucleic acid. In some embodiments of any of the aspects, the first and second polypeptide fragments of the recombinase are brought into close proximity, resulting in complementation of the two recombinase polypeptide fragments to form the active recombinase protein. In some embodiments of any of the aspects, the active recombinase protein specifically binds to the at least one RRS in the detection nucleic acid, causing a recombination event that allows for expression (e.g., translation) of the detectable marker polypeptide (see e.g., FIG. 25).

In one aspect described herein is a method of modulating the expression of a target polypeptide, comprising: (a) providing a population of cells comprising a polypeptide system as described herein (e.g., an inducible split-nuclease split-recombinase system); and (b) contacting the cells with the guide nucleic acid for the sequence-specific nuclease of the polypeptide system. In some embodiments of any of the aspects, the method further comprises contacting the cells with a target nucleic acid encoding the target polypeptide. In some embodiments of any of the aspects, the target nucleic acid comprises sites specifically bound and cleaved by the active sequence-specific nuclease of the polypeptide system. In some embodiments of any of the aspects, the method further comprises contacting the cells with a target nucleic acid encoding the target polypeptide. In some embodiments of any of the aspects, the target nucleic acid comprises recombination sites specifically bound and cleaved by the active recombinase of the polypeptide system.

In one aspect described herein is a method of treating a subject in need of a cell-based therapy, comprising: (a) administering to the subject a population of cells comprising a polypeptide system as described herein (e.g., an inducible split-nuclease split-recombinase system); and (b) administering to the subject an effective amount of the guide nucleic acid for the sequence-specific nuclease of the polypeptide system. In some embodiments of any of the aspects, the method further comprises administering a target nucleic acid encoding the target polypeptide, wherein the target nucleic acid comprises sites specifically bound and cleaved by the active sequence-specific nuclease of the polypeptide system. In some embodiments of any of the aspects, the method further comprises administering a target nucleic acid encoding the target polypeptide, wherein the target nucleic acid comprises recombination sites specifically bound and cleaved by the active recombinase of the polypeptide system.

In some embodiments of any of the aspects, in the presence of the guide nucleic acid and target nucleic acid(s), the recombinase and/or nuclease are active. In some embodiments of any of the aspects, in the presence of the guide nucleic acid and target nucleic acid(s), the recombinase is active. In some embodiments of any of the aspects, in the presence of the guide nucleic acid and target nucleic acid(s), the nuclease is active. In some embodiments of any of the aspects, in the absence of the guide nucleic acid and target nucleic acid(s), the recombinase and/or nuclease are inactive. In some embodiments of any of the aspects, in the absence of the guide nucleic acid and target nucleic acid(s), the recombinase is inactive. In some embodiments of any of the aspects, in the absence of the guide nucleic acid and target nucleic acid(s), the nuclease is inactive.

In some embodiments of any of the aspects, the expression of the target polypeptide is increased when the active recombinase or active sequence-specific nuclease cleaves a portion of the target polynucleotide that inhibits expression of the target polypeptide. In some embodiments of any of the aspects, the expression of the target polypeptide is decreased when the active recombinase or active sequence-specific nuclease cleaves a portion of the target polynucleotide that induces expression of the target polypeptide or a portion of the target polynucleotide that encodes for the target polypeptide.

In some embodiments of any of the aspects, a first and/or second polypeptide as described herein further comprises a cytosolic sequestering domain (e.g., ERT, NLS, NES, Syn-Notch, etc.). In some embodiments of any of the aspects, a method as described herein (e.g., for modulating the expression of a target polypeptide) further comprises contacting the cell with a ligand for the cytosolic sequestering domain. In some embodiments of any of the aspects, a method as described herein (e.g., for treating a subject in need of a cell-based therapy) further comprises administering a ligand for the cytosolic sequestering domain. In some embodiments of any of the aspects, the ligand for the cytosolic sequestering domain is selected from: tamoxifen, 4-hydroxytamoxifen (4OHT), endoxifen, and Fulvestrant.

Accordingly, in one aspect described herein is a method of modulating the expression of a target polypeptide, comprising: providing a population of cells comprising a polypeptide system as described herein (e.g., a system comprising at least one sequestering domain); and (b) contacting the cells with a ligand for the cytosolic sequestering domain. In another aspect described herein is a method of treating a subject in need of a cell-based therapy, comprising: administering to the subject a population of cells comprising a polypeptide system as described herein (e.g., a system comprising at least one sequestering domain); and (b) administering to the subject an effective amount of a ligand for the cytosolic sequestering domain.

Figure 23:
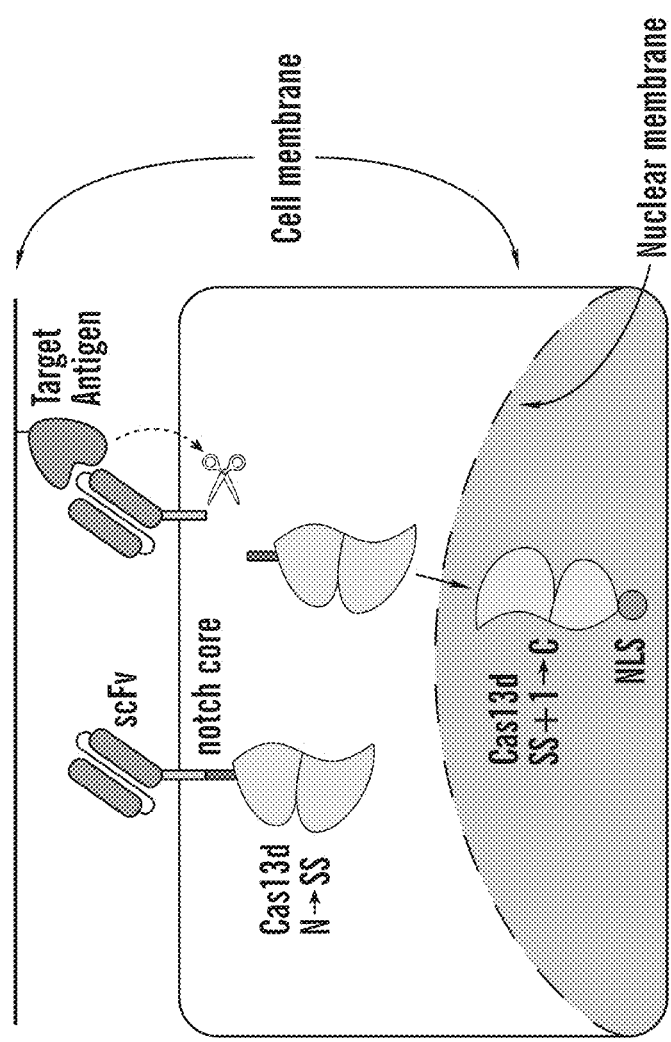
FIG. 23 is a schematic of a synNotch inducible split Cas13 system.

In some embodiments of any of the aspects, in the presence of the ligand for the cytosolic sequestering domain, the first and/or or second polypeptide (e.g., the polypeptide(s) comprising a sequestering domain) is translocated to the nucleus (see e.g., FIG. 23). In some embodiments of any of the aspects, in the presence of the ligand for the cytosolic sequestering domain, the first or second polypeptide binds to its cognate second or first polypeptide in the nucleus.

In some embodiments of any of the aspects, in the absence of the ligand for the cytosolic sequestering domain, the first or second polypeptide (e.g., the polypeptide(s) comprising a sequestering domain) is not translocated to the nucleus. In some embodiments of any of the aspects, in the absence of the ligand for the cytosolic sequestering domain, the first or second polypeptide does not bind to its cognate second or first polypeptide in the nucleus.

Figure 13A:
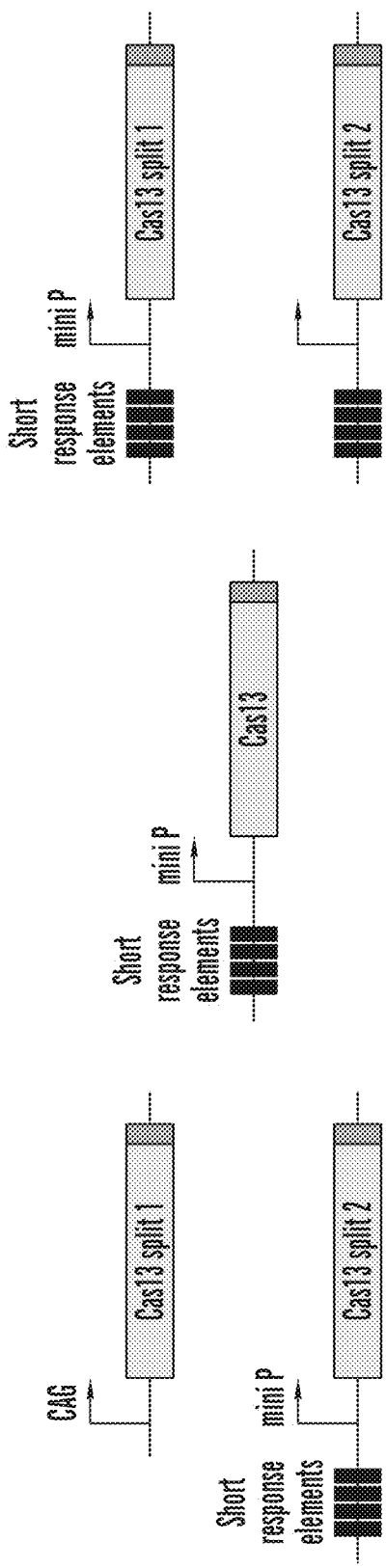
FIG. 13A-13E is a series of schematics and graphs showing the coupling of split Cas13 (559/560) expression to inducible promoters responsive to endogenous signals. Inducible promoters responsive to endogenous signals drove split Cas13 expression for the construction of AND logic gate.

In some embodiments of any of the aspects, a first and/or second polypeptide as described herein is operatively linked to an inducible promoter (see e.g., FIG. 13A). In some embodiments of any of the aspects, a method as described herein (e.g., for modulating the expression of a target polypeptide) further comprises contacting the cell with a ligand for the inducible promoter. In some embodiments of any of the aspects, a method as described herein (e.g., for treating a subject in need of a cell-based therapy) further comprises administering a ligand for the inducible promoter. In some embodiments of any of the aspects, the ligand for the inducible promoter is PMA, TGF-beta, TNFa, or WNT. In some embodiments of any of the aspects, the ligand for the inducible promoter is doxycycline.

Accordingly, in one aspect described herein is a method of modulating the expression of a target polypeptide, comprising: (a) providing a population of cells comprising a polypeptide system as described herein (e.g., wherein the expression of at least one polypeptide in the system is controlled by an inducible promoter); and (b) contacting the cells with a ligand for the inducible promoter. In another aspect described herein is a method of treating a subject in need of a cell-based therapy, comprising: (a) administering to the subject a population of cells comprising a polypeptide system as described herein (e.g., wherein the expression of at least one polypeptide in the system is controlled by an inducible promoter); and (b) administering to the subject an effective amount of a ligand for the inducible promoter.

In some embodiments of any of the aspects, in the presence of the ligand for the inducible promoter, the first and/or second polypeptide is expressed. In some embodiments of any of the aspects, in the presence of the ligand for the inducible promoter, the first polypeptide is expressed. In some embodiments of any of the aspects, in the presence of the ligand for the inducible promoter, the second polypeptide is expressed. In some embodiments of any of the aspects, in the absence of the ligand for the inducible promoter, the first and/or second polypeptide is not expressed. In some embodiments of any of the aspects, in the absence of the ligand for the inducible promoter, the first polypeptide is not expressed. In some embodiments of any of the aspects, in the absence of the ligand for the inducible promoter, the second polypeptide is not expressed.

In some embodiments of any of the aspects, there is a lag time of 5 minutes or less, 4 minutes or less, 3 minutes or less, 2 minutes or less, 1 minute or less, 30 seconds or less, 25 seconds or less, 20 seconds or less, 15 seconds or less, 10 seconds or less, 5 seconds or less in between protein complementation of the two polypeptide fragments in the presence of the inducer agent or inducer signal and the protein being in its active state.

In some embodiments of any of the aspects, there is a lag time of 5 minutes or less, 4 minutes or less, 3 minutes or less, 2 minutes or less, 1 minute or less, 30 seconds or less, 25 seconds or less, 20 seconds or less, 15 seconds or less, 10 seconds or less, 5 seconds or less in between protein complementation of the two polypeptide fragments in the absence of the repressor agent or repressor signal and the protein being in its active state.

In some embodiments of any of the aspects, there is a lag time of 5 minutes or less, 4 minutes or less, 3 minutes or less, 2 minutes or less, 1 minute or less, 30 seconds or less, 25 seconds or less, 20 seconds or less, 15 seconds or less, 10 seconds or less, 5 seconds or less in between protein un-complementation of the two polypeptide fragments in the presence of the repressor agent or repressor signal and the protein being in its inactive state.

In some embodiments of any of the aspects, there is a lag time of 5 minutes or less, 4 minutes or less, 3 minutes or less, 2 minutes or less, 1 minute or less, 30 seconds or less, 25 seconds or less, 20 seconds or less, 15 seconds or less, 10 seconds or less, 5 seconds or less in between protein complementation of the two polypeptide fragments in the presence of the guide nucleic acids and the protein being in its active state.

In some embodiments of any of the aspects, there is a lag time of 5 minutes or less, 4 minutes or less, 3 minutes or less, 2 minutes or less, 1 minute or less, 30 seconds or less, 25 seconds or less, 20 seconds or less, 15 seconds or less, 10 seconds or less, 5 seconds or less in between protein complementation of the two polypeptide fragments in the presence of the guide nucleic acid and the protein being in its active state.

In some embodiments of any of the aspects, there is a lag time of 5 minutes or less, 4 minutes or less, 3 minutes or less, 2 minutes or less, 1 minute or less, 30 seconds or less, 25 seconds or less, 20 seconds or less, 15 seconds or less, 10 seconds or less, 5 seconds or less or less in between nuclear translocation in the presence of the ligand for the sequestering domain and the protein being in its active state.

In some embodiments of any of the aspects, there is a lag time of 5 minutes or less, 4 minutes or less, 3 minutes or less, 2 minutes or less, 1 minute or less, 30 seconds or less, 25 seconds or less, 20 seconds or less, 15 seconds or less, 10 seconds or less, 5 seconds or less in between the ligand binding to the inducible promoter and the start of transcription of the polynucleotide operatively linked to the inducible promoter.

In some embodiments of any of the aspects, there is a lag time of 12 hours or less, 6 hours or less, 5 hours or less, 4 hours or less, 3 hours or less, 2 hours or less, 60 minutes or less, 50 minutes or less, 40 minutes or less, 30 minutes or less, 20 minutes or less, 10 minutes or less in between the ligand binding to the inducible promoter and the start of translation of the polypeptide encoded by the polynucleotide operatively linked to the inducible promoter.

As used herein, the term "cancer" relates generally to a class of diseases or conditions in which abnormal cells divide without control and can invade nearby tissues. Cancer cells can also spread to other parts of the body through the blood and lymph systems. There are several main types of cancer. Carcinoma is a cancer that begins in the skin or in tissues that line or cover internal organs. Sarcoma is a cancer that begins in bone, cartilage, fit, muscle, blood vessels, or other connective or supportive tissue. Leukemia is a cancer that starts in blood-forming tissue such as the bone marrow, and causes large numbers of abnormal blood cells to be produced and enter the blood. Lymphoma and multiple myeloma are cancers that begin in the cells of the immune system. Central nervous system cancers are cancers that begin in the tissues of the brain and spinal cord.

In some embodiments of any of the aspects, the cancer is a primary cancer. In some embodiments of any of the aspects, the cancer is a malignant cancer. As used herein, the term "malignant" refers to a cancer in which a group of tumor cells display one or more of uncontrolled growth (i.e., division beyond normal limits), invasion (i.e., intrusion on and destruction of adjacent tissues), and metastasis (i.e., spread to other locations in the body via lymph or blood). As used herein, the term "metastasize" refers to the spread of cancer from one part of the body to another. A tumor formed by cells that have spread is called a "metastatic tumor" or a "metastasis." The metastatic tumor contains cells that are like those in the original (primary) tumor. As used herein, the term "benign" or "non-malignant" refers to tumors that may grow larger but do not spread to other parts of the body. Benign tumors are self-limited and typically do not invade or metastasize.

A "cancer cell" or "tumor cell" refers to an individual cell of a cancerous growth or tissue. A tumor refers generally to a swelling or lesion formed by an abnormal growth of cells, which may be benign, pre-malignant, or malignant. Most cancer cells form tumors, but some, e.g., leukemia, do not necessarily form tumors. For those cancer cells that form tumors, the terms cancer (cell) and tumor (cell) are used interchangeably.

As used herein the term "neoplasm" refers to any new and abnormal growth of tissue, e.g., an abnormal mass of tissue, the growth of which exceeds and is uncoordinated with that of the normal tissues. Thus, a neoplasm can be a benign neoplasm, premalignant neoplasm, or a malignant neoplasm.

A subject that has a cancer or a tumor is a subject having objectively measurable cancer cells present in the subject's body. Included in this definition are malignant, actively proliferative cancers, as well as potentially dormant tumors or micrometastases. Cancers which migrate from their original location and seed other vital organs can eventually lead to the death of the subject through the functional deterioration of the affected organs.

Examples of cancer include but are not limited to, carcinoma, lymphoma, blastoma, sarcoma, leukemia, basal cell carcinoma, biliary tract cancer; bladder cancer; bone cancer; brain and CNS cancer; breast cancer; cancer of the peritoneum; cervical cancer; choriocarcinoma; colon and rectum cancer; connective tissue cancer; cancer of the digestive system; endometrial cancer; esophageal cancer; eye cancer; cancer of the head and neck; gastric cancer (including gastrointestinal cancer); glioblastoma (GBM); hepatic carcinoma; hepatoma; intra-epithelial neoplasm; kidney or renal cancer; larynx cancer; leukemia; liver cancer; lung cancer (e.g., small-cell lung cancer, non-small cell lung cancer, adenocarcinoma of the lung, and squamous carcinoma of the lung); lymphoma including Hodgkin's and non-Hodgkin's lymphoma; melanoma; myeloma; neuroblastoma; oral cavity cancer (e.g., lip, tongue, mouth, and pharynx); ovarian cancer; pancreatic cancer; prostate cancer; retinoblastoma; rhabdomyosarcoma; rectal cancer; cancer of the respiratory system; salivary gland carcinoma; sarcoma; skin cancer; squamous cell cancer; stomach cancer; testicular cancer; thyroid cancer; uterine or endometrial cancer; cancer of the urinary system; vulval cancer; as well as other carcinomas and sarcomas; as well as B-cell lymphoma (including low grade/follicular non-Hodgkin's lymphoma (NHL); small lymphocytic (SL) NHL; intermediate grade/follicular NHL; intermediate grade diffuse NHL; high grade immunoblastic NHL; high grade lymphoblastic NHL; high grade small non-cleaved cell NHL; bulky disease NHL; mantle cell lymphoma; AIDS-related lymphoma; and Waldenstrom's Macroglobulinemia); chronic lymphocytic leukemia (CLL); acute lymphoblastic leukemia (ALL); Hairy cell leukemia; chronic myeloblastic leukemia; and post-transplant lymphoproliferative disorder (PTLD), as well as abnormal vascular proliferation associated with phakomatoses, edema (such as that associated with brain tumors), and Meigs' syndrome.

A "cancer cell" is a cancerous, pre-cancerous, or transformed cell, either in vivo, ex vivo, or in tissue culture, that has spontaneous or induced phenotypic changes that do not necessarily involve the uptake of new genetic material. Although transformation can arise from infection with a transforming virus and incorporation of new genomic nucleic acid, or uptake of exogenous nucleic acid, it can also arise spontaneously or following exposure to a carcinogen, thereby mutating an endogenous gene. Transformation/cancer is associated with, e.g., morphological changes, immortalization of cells, aberrant growth control, foci formation, anchorage independence, malignancy, loss of contact inhibition and density limitation of growth, growth factor or serum independence, tumor specific markers, invasiveness or metastasis, and tumor growth in suitable animal hosts such as nude mice.

In various embodiments, an immune cell (e.g., Treg) comprising a polypeptide or system can be used to treat an autoimmune disease. In some embodiments, an immune cell (e.g., T cell) comprising a polypeptide or system directed against an autoimmune disease-specific antigen can be used to treat an autoimmune disease. "Autoimmune disease" refers to a class of diseases in which a subject's own antibodies react with host tissue or in which immune effector T cells are autoreactive to endogenous self-peptides and cause destruction of tissue. Thus an immune response is mounted against a subject's own antigens, referred to as self-antigens. A "self-antigen" as used herein refers to an antigen of a normal host tissue. Normal host tissue does not include neoplastic cells.

Autoantigens, as used herein, are endogenous proteins or fragments thereof that elicit this pathogenic immune response. Autoantigen can be any substance or a portion thereof normally found within a mammal that, in an autoimmune disease, becomes the primary (or a primary) target of attack by the immune system. The term also includes antigenic substances that induce conditions having the characteristics of an autoimmune disease when administered to mammals. Additionally, the term includes peptic subclasses consisting essentially of immunodominant epitopes or immunodominant epitope regions of autoantigens. Immunodominant epitopes or regions in induced autoimmune conditions are fragments of an autoantigen that can be used instead of the entire autoantigen to induce the disease. In humans afflicted with an autoimmune disease, immunodominant epitopes or regions are fragments of antigens specific to the tissue or organ under autoimmune attack and recognized by a substantial percentage (e.g. a majority though not necessarily an absolute majority) of autoimmune attack T-cells.

Autoantigens that are known to be associated with autoimmune disease include myelin proteins with demyelinating diseases, e.g. multiple sclerosis and experimental autoimmune myelitis; collagens and rheumatoid arthritis; insulin, proinsulin, glutamic acid decarboxylase 65 (GAD65); islet cell antigen (ICA512; ICA12) with insulin dependent diabetes.

A common feature in a number of autoimmune related diseases and inflammatory conditions is the involvement of pro-inflammatory CD4+ T cells. These T cells are responsible for the release of inflammatory, Th1 type cytokines. Cytokines characterized as Th1 type include interleukin 2 (IL-2), γ-interferon, TNFα and IL-12. Such pro-inflammatory cytokines act to stimulate the immune response, in many cases resulting in the destruction of autologous tissue. Cytokines associated with suppression of T cell response are the T2 type, and include IL-10, IL-4 and TGF-β. It has been found that Th1 and Th2 type T cells may use the identical antigen receptor in response to an immunogen; in the former producing a stimulatory response and in the latter a suppressive response.

Provided herein is a method of treating an autoimmune disease, which comprises administering an effective amount of a composition to a patient in need thereof. In one embodiment of any one of the methods described, the autoimmune disorder is selected from the group consisting of thyroiditis, type 1 diabetes mellitus, Hashimoto's thyroidits, Graves' disease, celiac disease, multiple sclerosis, Guillain-Barre syndrome, Addison's disease, and Raynaud's phenomenon, Goodpasture's disease, arthritis (rheumatoid arthritis such as acute arthritis, chronic rheumatoid arthritis, gout or gouty arthritis, acute gouty arthritis, acute immunological arthritis, chronic inflammatory arthritis, degenerative arthritis, type II collagen-induced arthritis, infectious arthritis, Lyme arthritis, proliferative arthritis, psoriatic arthritis, Still's disease, vertebral arthritis, and juvenile-onset rheumatoid arthritis, arthritis chronica progrediente, arthritis deformans, polyarthritis chronica primaria, reactive arthritis, and ankylosing spondylitis), inflammatory hyperproliferative skin diseases, psoriasis such as plaque psoriasis, gutatte psoriasis, pustular psoriasis, and psoriasis of the nails, atopy including atopic diseases such as hay fever and Job's syndrome, dermatitis including contact dermatitis, chronic contact dermatitis, exfoliative dermatitis, allergic dermatitis, allergic contact dermatitis, dermatitis herpetiformis, nummular dermatitis, seborrheic dermatitis, non-specific dermatitis, primary irritant contact dermatitis, and atopic dermatitis, x-linked hyper IgM syndrome, allergic intraocular inflammatory diseases, urticaria such as chronic allergic urticaria and chronic idiopathic urticaria, including chronic autoimmune urticaria, myositis, polymyositis/dermatomyositis, juvenile dermatomyositis, toxic epidermal necrolysis, scleroderma (including systemic scleroderma), sclerosis such as systemic sclerosis, multiple sclerosis (MS) such as spino-optical MS, primary progressive MS (PPMS), and relapsing remitting MS (RRMS), progressive systemic sclerosis, atherosclerosis, arteriosclerosis, sclerosis disseminata, ataxic sclerosis, neuromyelitis optica (NMO), inflammatory bowel disease (IBD) (for example, Crohn's disease, autoimmune-mediated gastrointestinal diseases, colitis such as ulcerative colitis, colitis ulcerosa, microscopic colitis, collagenous colitis, colitis polyposa, necrotizing enterocolitis, and transmural colitis, and autoimmune inflammatory bowel disease), bowel inflammation, pyoderma gangrenosum, erythema nodosum, primary sclerosing cholangitis, respiratory distress syndrome, including adult or acute respiratory distress syndrome (ARDS), meningitis, inflammation of all or part of the uvea, iritis, choroiditis, an autoimmune hematological disorder, rheumatoid spondylitis, rheumatoid synovitis, hereditary angioedema, cranial nerve damage as in meningitis, herpes gestationis, pemphigoid gestationis, pruritis scroti, autoimmune premature ovarian failure, sudden hearing loss due to an autoimmune condition, IgE-mediated diseases such as anaphylaxis and allergic and atopic rhinitis, encephalitis such as Rasmussen's encephalitis and limbic and/or brainstem encephalitis, uveitis, such as anterior uveitis, acute anterior uveitis, granulomatous uveitis, non-granulomatous uveitis, phacoantigenic uveitis, posterior uveitis, or autoimmune uveitis, glomerulonephritis (GN) with and without nephrotic syndrome such as chronic or acute glomerulonephritis such as primary GN, immune-mediated GN, membranous GN (membranous nephropathy), idiopathic membranous GN or idiopathic membranous nephropathy, membrano- or membranous proliferative GN (MPGN), including Type I and Type II, and rapidly progressive GN, proliferative nephritis, autoimmune polyglandular endocrine failure, balanitis including balanitis circumscripta plasmacellularis, balanoposthitis, erythema annulare centrifugum, erythema dyschromicum perstans, eythema multiform, granuloma annulare, lichen nitidus, lichen sclerosus et atrophicus, lichen simplex chronicus, lichen spinulosus, lichen planus, lamellar ichthyosis, epidermolytic hyperkeratosis, premalignant keratosis, pyoderma gangrenosum, allergic conditions and responses, allergic reaction, eczema including allergic or atopic eczema, asteatotic eczema, dyshidrotic eczema, and vesicular palmoplantar eczema, asthma such as asthma bronchiale, bronchial asthma, and auto-immune asthma, conditions involving infiltration of T cells and chronic inflammatory responses, immune reactions against foreign antigens such as fetal A-B-O blood groups during pregnancy, chronic pulmonary inflammatory disease, autoimmune myocarditis, leukocyte adhesion deficiency, lupus, including lupus nephritis, lupus cerebritis, pediatric lupus, non-renal lupus, extra-renal lupus, discoid lupus and discoid lupus erythematosus, alopecia lupus, systemic lupus erythematosus (SLE) such as cutaneous SLE or subacute cutaneous SLE, neonatal lupus syndrome (NLE), and lupus erythematosus disseminatus, juvenile onset (Type I) diabetes mellitus, including pediatric insulin-dependent diabetes mellitus (IDDM), adult onset diabetes mellitus (Type II diabetes), autoimmune diabetes, idiopathic diabetes insipidus, diabetic retinopathy, diabetic nephropathy, diabetic large-artery disorder, immune responses associated with acute and delayed hypersensitivity mediated by cytokines and T-lymphocytes, sarcoidosis, granulomatosis including lymphomatoid granulomatosis, Wegener's granulomatosis, agranulocytosis, vasculitides, including vasculitis, large-vessel vasculitis (including polymyalgia rheumatica and giant-cell (Takayasu's) arteritis), medium-vessel vasculitis (including Kawasaki's disease and polyarteritis nodosa/periarteritis nodosa), microscopic polyarteritis, immunovasculitis, CNS vasculitis, cutaneous vasculitis, hypersensitivity vasculitis, necrotizing vasculitis such as systemic necrotizing vasculitis, and ANCA-associated vasculitis, such as Churg-Strauss vasculitis or syndrome (CSS) and ANCA-associated small-vessel vasculitis, temporal arteritis, autoimmune aplastic anemia, Coombs positive anemia, Diamond Blackfan anemia, hemolytic anemia or immune hemolytic anemia including autoimmune hemolytic anemia (AIHA), pernicious anemia (anemia perniciosa), Addison's disease, pure red cell anemia or aplasia (PRCA), Factor VIII deficiency, hemophilia A, autoimmune neutropenia, pancytopenia, leukopenia, diseases involving leukocyte diapedesis, CNS inflammatory disorders, multiple organ injury syndrome such as those secondary to septicemia, trauma or hemorrhage, antigen-antibody complex-mediated diseases, anti-glomerular basement membrane disease, anti-phospholipid antibody syndrome, allergic neuritis, Behcet's disease/syndrome, Castleman's syndrome, Goodpasture's syndrome, Reynaud's syndrome, Sjogren's syndrome, Stevens-Johnson syndrome, pemphigoid such as pemphigoid bullous and skin pemphigoid, pemphigus (including pemphigus vulgaris, pemphigus foliaceus, pemphigus mucus-membrane pemphigoid, and pemphigus erythematosus), autoimmune polyendocrinopathies, Reiter's disease or syndrome, an immune complex disorder such as immune complex nephritis, antibody-mediated nephritis, polyneuropathies, chronic neuropathy such as IgM polyneuropathies or IgM-mediated neuropathy, and autoimmune or immune-mediated thrombocytopenia such as idiopathic thrombocytopenic purpura (ITP) including chronic or acute ITP, scleritis such as idiopathic cerato-scleritis, episcleritis, autoimmune disease of the testis and ovary including autoimmune orchitis and oophoritis, primary hypothyroidism, hypoparathyroidism, autoimmune endocrine diseases including thyroiditis such as autoimmune thyroiditis, Hashimoto's disease, chronic thyroiditis (Hashimoto's thyroiditis), or subacute thyroiditis, idiopathic hypothyroidism, Grave's disease, polyglandular syndromes such as autoimmune polyglandular syndromes (or polyglandular endocrinopathy syndromes), paraneoplastic syndromes, including neurologic paraneoplastic syndromes such as Lambert-Eaton myasthenic syndrome or Eaton-Lambert syndrome, stiff-man or stiff-person syndrome, encephalomyelitis such as allergic encephalomyelitis or encephalomyelitis allergica and experimental allergic encephalomyelitis (EAE), myasthenia gravis such as thymoma-associated myasthenia gravis, cerebellar degeneration, neuromyotonia, opsoclonus or opsoclonus myoclonus syndrome (OMS), and sensory neuropathy, multifocal motor neuropathy, Sheehan's syndrome, autoimmune hepatitis, lupoid hepatitis, giant-cell hepatitis, autoimmune chronic active hepatitis, lymphoid interstitial pneumonitis (LIP), bronchiolitis obliterans (non-transplant) vs NSIP, Guillain-Barre syndrome, Berger's disease (IgA nephropathy), idiopathic IgA nephropathy, linear IgA dermatosis, acute febrile neutrophilic dermatosis, subcorneal pustular dermatosis, transient acantholytic dermatosis, cirrhosis such as primary biliary cirrhosis and pneumonocirrhosis, autoimmune enteropathy syndrome, Celiac or Coeliac disease, celiac sprue (gluten enteropathy), refractory sprue, idiopathic sprue, cryoglobulinemia, amylotrophic lateral sclerosis (ALS; Lou Gehrig's disease), coronary artery disease, autoimmune ear disease such as autoimmune inner ear disease (AIED), autoimmune hearing loss, polychondritis such as refractory or relapsed or relapsing polychondritis, pulmonary alveolar proteinosis, Cogan's syndrome/nonsyphilitic interstitial keratitis, Bell's palsy, Sweet's disease/syndrome, rosacea autoimmune, zoster-associated pain, amyloidosis, a non-cancerous lymphocytosis, a primary lymphocytosis, which includes monoclonal B cell lymphocytosis (e.g., benign monoclonal gammopathy and monoclonal gammopathy of undetermined significance, MGUS), peripheral neuropathy, paraneoplastic syndrome, channelopathies including channelopathies of the CNS, autism, inflammatory myopathy, focal or segmental or focal segmental glomerulosclerosis (FSGS), endocrine opthalmopathy, uveoretinitis, chorioretinitis, autoimmune hepatological disorder, fibromyalgia, multiple endocrine failure, Schmidt's syndrome, adrenalitis, gastric atrophy, presenile dementia, demyelinating diseases such as autoimmune demyelinating diseases and chronic inflammatory demyelinating polyneuropathy, Dressler's syndrome, alopecia areata, alopecia totalis, CREST syndrome (calcinosis, Raynaud's phenomenon, esophageal dysmotility, sclerodactyly, and telangiectasia), male and female autoimmune infertility, e.g., due to anti-spermatozoan antibodies, mixed connective tissue disease, Chagas' disease, rheumatic fever, recurrent abortion, farmer's lung, erythema multiforme, post-cardiotomy syndrome, Cushing's syndrome, bird-fancier's lung, allergic granulomatous angiitis, benign lymphocytic angiitis, Alport's syndrome, alveolitis such as allergic alveolitis and fibrosing alveolitis, interstitial lung disease, transfusion reaction, Sampter's syndrome, Caplan's syndrome, endocarditis, endomyocardial fibrosis, diffuse interstitial pulmonary fibrosis, interstitial lung fibrosis, pulmonary fibrosis, idiopathic pulmonary fibrosis, cystic fibrosis, endophthalmitis, erythema elevatum et diutinum, erythroblastosis fetalis, eosinophilic faciitis, Shulman's syndrome, Felty's syndrome, cyclitis such as chronic cyclitis, heterochronic cyclitis, iridocyclitis (acute or chronic), or Fuch's cyclitis, Henoch-Schonlein purpura, SCID, sepsis, endotoxemia, post-vaccination syndromes, Evan's syndrome, autoimmune gonadal failure, Sydenham's chorea, post-streptococcal nephritis, thromboangitis ubiterans, thyrotoxicosis, tabes dorsalis, chorioiditis, giant-cell polymyalgia, chronic hypersensitivity pneumonitis, keratoconjunctivitis sicca, idiopathic nephritic syndrome, minimal change nephropathy, benign familial and ischemia-reperfusion injury, transplant organ reperfusion, retinal autoimmunity, aphthae, aphthous stomatitis, arteriosclerotic disorders, aspermiogenesis, autoimmune hemolysis, Boeck's disease, enteritis allergica, erythema nodosum leprosum, idiopathic facial paralysis, chronic fatigue syndrome, febris rheumatica, Hamman-Rich's disease, sensoneural hearing loss, ileitis regionalis, leucopenia, transverse myelitis, primary idiopathic myxedema, ophthalmia symphatica, polyradiculitis acuta, pyoderma gangrenosum, acquired splenic atrophy, vitiligo, toxic-shock syndrome, conditions involving infiltration of T cells, leukocyte-adhesion deficiency, immune responses associated with acute and delayed hypersensitivity mediated by cytokines and T-lymphocytes, diseases involving leukocyte diapedesis, multiple organ injury syndrome, antigen-antibody complex-mediated diseases, antiglomerular basement membrane disease, allergic neuritis, autoimmune polyendocrinopathies, oophoritis, primary myxedema, autoimmune atrophic gastritis, rheumatic diseases, mixed connective tissue disease, nephrotic syndrome, insulitis, polyendocrine failure, autoimmune polyglandular syndrome type I, adult-onset idiopathic hypoparathyroidism (AOIH), myocarditis, nephrotic syndrome, primary sclerosing cholangitis, acute or chronic sinusitis, ethmoid, frontal, maxillary, or sphenoid sinusitis, an eosinophil-related disorder such as eosinophilia, pulmonary infiltration eosinophilia, eosinophilia-myalgia syndrome, Loffler's syndrome, chronic eosinophilic pneumonia, tropical pulmonary eosinophilia, granulomas containing eosinophils, seronegative spondyloarthritides, polyendocrine autoimmune disease, sclerosing cholangitis, sclera, episclera, Bruton's syndrome, transient hypogammaglobulinemia of infancy, Wiskott-Aldrich syndrome, ataxia telangiectasia syndrome, angiectasis, autoimmune disorders associated with collagen disease, rheumatism, allergic hypersensitivity disorders, glomerulonephritides, reperfusion injury, ischemic re-perfusion disorder, lymphomatous tracheobronchitis, inflammatory dermatoses, dermatoses with acute inflammatory components, and autoimmune uveoretinitis (AUR).

Another aspect of the technology described herein relates to kits for modulating the expression of a target gene and/or treating a subject in need of cell therapy, among others. Described herein are kit components that can be included in one or more of the kits described herein.

In some embodiments, the kit comprises an effective amount of a polypeptide or polypeptide system as described herein. As will be appreciated by one of skill in the art, the polypeptide or polypeptide system can be supplied in a lyophilized form or a concentrated form that can diluted or suspended in liquid prior to use, e.g., with cells. Preferred formulations include those that are non-toxic to the cells and/or does not affect growth rate or viability and can be supplied in aliquots or in unit doses.

In some embodiments the kit further comprises a vector comprising a nucleic acid encoding polypeptide or polypeptide system as described herein. In some embodiments, the polypeptide or polypeptide system is under the control of an inducible promoter, e.g., for inducible expression in vitro, in vivo, or ex vivo.

In some embodiments, the components described herein can be provided singularly or in any combination as a kit. Such a kit includes the components described herein, e.g., a composition comprising a polypeptide or polypeptide system as described herein or a composition that includes a vector comprising a polypeptide or polypeptide system as described herein.

In some embodiments, the kit comprises an inducer agent as described herein (e.g., caffeine, abscisic acid, rapamycin, gibberellin, protease inhibitor, or analogs thereof). In some embodiments, the kit comprises a device for producing an inducer signal as described herein (e.g., a device that produces light, blue light, and/or pulsed light). In some embodiments, the kit comprises a repressor agent as described herein (e.g., protease inhibitor). In some embodiments, the kit comprises a guide nucleic acid as described herein. In some embodiments, the kit comprises a ligand for a sequestering domain as described herein (e.g., tamoxifen, 4-hydroxytamoxifen (4OHT), endoxifen, Fulvestrant). In some embodiments, the kit comprises a ligand for an inducible promoter as described herein (e.g., PMA, TGF-beta, TNFa, WNT or analogs thereof; e.g., doxycycline). In some embodiments of any of the aspects, the inducer agent, repressor agent, guide nucleic acid, ligand for a sequestering domain, or ligand for an inducible promoter are supplied in a lyophilized form or a concentrated form that can diluted or suspended in liquid prior to use.

In some embodiments, the compositions in the kit can be provided in a watertight or gas tight container which in some embodiments is substantially free of other components of the kit. For example, a composition can be supplied in more than one container, e.g., it can be supplied in a container having sufficient reagent for a predetermined number of cell culture events, e.g., 1, 2, 3 or greater. One or more components as described herein can be provided in any form, e.g., liquid, dried or lyophilized form. It is preferred that the components described herein are substantially pure and/or sterile. When the components described herein are provided in a liquid solution, the liquid solution preferably is an aqueous solution, with a sterile aqueous solution being preferred.

In addition, the kit optionally comprises informational material. The informational material can be descriptive, instructional, marketing or other material that relates to the methods described herein. The informational material of the kits is not limited in its form. In one embodiment, the informational material can include information about production of the polypeptide or polypeptide system, concentration, date of expiration, batch or production site information, and so forth. In one embodiment, the informational material relates to methods for using or administering the components of the kit.

The kit is typically provided with its various elements included in one package, e.g., a fiber-based, e.g., a cardboard, or polymeric, e.g., a Styrofoam box. The enclosure can be configured so as to maintain a temperature differential between the interior and the exterior, e.g., it can provide insulating properties to keep the reagents at a preselected temperature for a preselected time.

For convenience, the meaning of some terms and phrases used in the specification, examples, and appended claims, are provided below. Unless stated otherwise, or implicit from context, the following terms and phrases include the meanings provided below. The definitions are provided to aid in describing particular embodiments, and are not intended to limit the claimed invention, because the scope of the invention is limited only by the claims. Unless otherwise defined, all technical and scientific terms used herein have the same meaning as commonly understood by one of ordinary skill in the art to which this invention belongs. If there is an apparent discrepancy between the usage of a term in the art and its definition provided herein, the definition provided within the specification shall prevail.

For convenience, certain terms employed herein, in the specification, examples and appended claims are collected here.

The terms "decrease", "reduced", "reduction", or "inhibit" are all used herein to mean a decrease by a statistically significant amount. In some embodiments, "reduce," "reduction" or "decrease" or "inhibit" typically means a decrease by at least 10% as compared to a reference level (e.g. the absence of a given treatment or agent) and can include, for example, a decrease by at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 98%, at least about 99%, or more. As used herein, "reduction" or "inhibition" does not encompass a complete inhibition or reduction as compared to a reference level. "Complete inhibition" is a 100% inhibition as compared to a reference level. A decrease can be preferably down to a level accepted as within the range of normal, e.g., for an individual without a given disorder.

The terms "increased", "increase", "enhance", or "activate" are all used herein to mean an increase by a statically significant amount. In some embodiments, the terms "increased", "increase", "enhance", or "activate" can mean an increase of at least 10% as compared to a reference level, for example an increase of at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, or at least about a 2-fold, or at least about a 3-fold, or at least about a 4-fold, or at least about a 5-fold or at least about a 10-fold increase, or any increase between 2-fold and 10-fold or greater as compared to a reference level. In the context of a marker or symptom, an "increase" is a statistically significant increase in such level.

As used herein, a "subject" means a human or animal. Usually the animal is a vertebrate such as a primate, rodent, domestic animal or game animal. Primates include chimpanzees, cynomolgus monkeys, spider monkeys, and macaques, e.g., Rhesus. Rodents include mice, rats, woodchucks, ferrets, rabbits and hamsters. Domestic and game animals include cows, horses, pigs, deer, bison, buffalo, feline species, e.g., domestic cat, canine species, e.g., dog, fox, wolf, avian species, e.g., chicken, emu, ostrich, and fish, e.g., trout, catfish and salmon. In some embodiments, the subject is a mammal, e.g., a primate, e.g., a human. The terms, "individual," "patient" and "subject" are used interchangeably herein.

Preferably, the subject is a mammal. The mammal can be a human, non-human primate, mouse, rat, dog, cat, horse, or cow, but is not limited to these examples. Mammals other than humans can be advantageously used as subjects that represent animal models of cancer. A subject can be male or female.

A subject can be one who has been previously diagnosed with or identified as suffering from or having a condition in need of treatment (e.g. cancer) or one or more complications related to such a condition, and optionally, have already undergone treatment for the disease or disorder (e.g., cancer) or the one or more complications related to the disease or disorder (e.g., cancer). Alternatively, a subject can also be one who has not been previously diagnosed as having the disease or disorder (e.g., cancer) or one or more complications related to the disease or disorder (e.g., cancer). For example, a subject can be one who exhibits one or more risk factors for the disease or disorder (e.g., cancer) or one or more complications related to the disease or disorder (e.g., cancer) or a subject who does not exhibit risk factors.

A "subject in need" of treatment for a particular condition can be a subject having that condition, diagnosed as having that condition, or at risk of developing that condition.

As used herein, the terms "protein" and "polypeptide" are used interchangeably to designate a series of amino acid residues, connected to each other by peptide bonds between the alpha-amino and carboxy groups of adjacent residues. The terms "protein", and "polypeptide" refer to a polymer of amino acids, including modified amino acids (e.g., phosphorylated, glycated, glycosylated, etc.) and amino acid analogs, regardless of its size or function. "Protein" and "polypeptide" are often used in reference to relatively large polypeptides, whereas the term "peptide" is often used in reference to small polypeptides, but usage of these terms in the art overlaps. The terms "protein" and "polypeptide" are used interchangeably herein when referring to a gene product and fragments thereof. Thus, exemplary polypeptides or proteins include gene products, naturally occurring proteins, homologs, orthologs, paralogs, fragments and other equivalents, variants, fragments, and analogs of the foregoing.

In some embodiments of any of the aspects, a polypeptide described herein that is illustrated with its first amino acid as a methionine does not comprise the methionine in some embodiments, e.g., when the polypeptide is included as a domain within a larger polypeptide. In some embodiments of any of the aspects, a polypeptide described herein that is illustrated with its first amino acid as an amino acid other than methionine can further comprise a methionine as its first amino acid in some embodiments, e.g., when the polypeptide is an N-terminal domain in a larger polypeptide. In some embodiments of any of the aspects, a polypeptide described herein that is illustrated with its first amino acid as a methionine does not include methionine in a numbering of its amino acids (i.e., the numbering begins with the amino acid immediately C-terminal of the starting methionine).

In the various embodiments described herein, it is further contemplated that variants (naturally occurring or otherwise), alleles, homologs, conservatively modified variants, and/or conservative substitution variants of any of the particular polypeptides described are encompassed. As to amino acid sequences, one of skill will recognize that individual substitutions, deletions or additions to a nucleic acid, peptide, polypeptide, or protein sequence which alters a single amino acid or a small percentage of amino acids in the encoded sequence is a "conservatively modified variant" where the alteration results in the substitution of an amino acid with a chemically similar amino acid and retains the desired activity of the polypeptide. Such conservatively modified variants are in addition to and do not exclude polymorphic variants, interspecies homologs, and alleles consistent with the disclosure.

A given amino acid can be replaced by a residue having similar physiochemical characteristics, e.g., substituting one aliphatic residue for another (such as Ile, Val, Leu, or Ala for one another), or substitution of one polar residue for another (such as between Lys and Arg; Glu and Asp; or Gln and Asn). Other such conservative substitutions, e.g., substitutions of entire regions having similar hydrophobicity characteristics, are well known. Polypeptides comprising conservative amino acid substitutions can be tested in any one of the assays described herein to confirm that a desired activity, e.g. function and specificity of a native or reference polypeptide is retained.

Amino acids can be grouped according to similarities in the properties of their side chains (in A. L. Lehninger, in Biochemistry, second ed., pp. 73-75, Worth Publishers, New York (1975)): (1) non-polar: Ala (A), Val (V), Leu (L), Ile (I), Pro (P), Phe (F), Trp (W), Met (M); (2) uncharged polar: Gly (G), Ser (S), Thr (T), Cys (C), Tyr (Y), Asn (N), Gln (Q); (3) acidic: Asp (D), Glu (E); (4) basic: Lys (K), Arg (R), His (H). Alternatively, naturally occurring residues can be divided into groups based on common side-chain properties: (1) hydrophobic: Norleucine, Met, Ala, Val, Leu, Ile; (2) neutral hydrophilic: Cys, Ser, Thr, Asn, Gln; (3) acidic: Asp, Glu; (4) basic: His, Lys, Arg; (5) residues that influence chain orientation: Gly, Pro; (6) aromatic: Trp, Tyr, Phe. Non-conservative substitutions can entail exchanging a member of one of these classes for another class. Particular conservative substitutions include, for example; Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val;

Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

In some embodiments, the polypeptide described herein (or a nucleic acid encoding such a polypeptide) can be a functional fragment of one of the amino acid sequences described herein. As used herein, a "functional fragment" is a fragment or segment of a peptide which retains at least 50% of the wild-type reference polypeptide's activity according to the assays described below herein. A functional fragment can comprise conservative substitutions of the sequences disclosed herein. In some embodiments of any of the aspects, a polypeptide can comprise the first N-terminal amino acid methionine. In embodiments where a polypeptide does not comprise a first N-terminal methionine, it is understood that a variant of the polypeptide does comprise a first N-terminal methionine.

In some embodiments, the polypeptide described herein can be a variant of a sequence described herein. In some embodiments, the variant is a conservatively modified variant. Conservative substitution variants can be obtained by mutations of native nucleotide sequences, for example. A "variant," as referred to herein, is a polypeptide substantially homologous to a native or reference polypeptide, but which has an amino acid sequence different from that of the native or reference polypeptide because of one or a plurality of deletions, insertions or substitutions. Variant polypeptide-encoding DNA sequences encompass sequences that comprise one or more additions, deletions, or substitutions of nucleotides when compared to a native or reference DNA sequence, but that encode a variant protein or fragment thereof that retains activity. A wide variety of PCR-based site-specific mutagenesis approaches are known in the art and can be applied by the ordinarily skilled artisan.

A variant amino acid or DNA sequence can be at least 70%, at least 75%, at least 80%, at least 85%, at least 90%, at least 91%, at least 92%, at least 93%, at least 94%, at least 95%, at least 96%, at least 97%, at least 98%, at least 99%, or more, identical to a native or reference sequence. The degree of homology (percent identity) between a native and a mutant sequence can be determined, for example, by comparing the two sequences using freely available computer programs commonly employed for this purpose on the world wide web (e.g. BLASTp or BLASTn with default settings).

Alterations of the native amino acid sequence can be accomplished by any of a number of techniques known to one of skill in the art. Mutations can be introduced, for example, at particular loci by synthesizing oligonucleotides containing a mutant sequence, flanked by restriction sites enabling ligation to fragments of the native sequence. Following ligation, the resulting reconstructed sequence encodes an analog having the desired amino acid insertion, substitution, or deletion. Alternatively, oligonucleotide-directed site-specific mutagenesis procedures can be employed to provide an altered nucleotide sequence having particular codons altered according to the substitution, deletion, or insertion required. Techniques for making such alterations are very well established and include, for example, those disclosed by Walder et al. (Gene 42:133, 1986); Bauer et al. (Gene 37:73, 1985); Craik (BioTechniques, January 1985, 12-19); Smith et al. (Genetic Engineering: Principles and Methods, Plenum Press, 1981); and U.S. Pat. Nos. 4,518,584 and 4,737,462, which are herein incorporated by reference in their entireties. Any cysteine residue not involved in maintaining the proper conformation of the polypeptide also can be substituted, generally with serine, to improve the oxidative stability of the molecule and prevent aberrant crosslinking. Conversely, cysteine bond(s) can be added to the polypeptide to improve its stability or facilitate oligomerization.

As used herein, the term "nucleic acid" or "nucleic acid sequence" refers to any molecule, preferably a polymeric molecule, incorporating units of ribonucleic acid, deoxyribonucleic acid or an analog thereof. The nucleic acid can be either single-stranded or double-stranded. A single-stranded nucleic acid can be one nucleic acid strand of a denatured double-stranded DNA. Alternatively, it can be a single-stranded nucleic acid not derived from any double-stranded DNA. In one aspect, the nucleic acid can be DNA. In another aspect, the nucleic acid can be RNA. Suitable DNA can include, e.g., genomic DNA, cDNA, or vector DNA. Suitable RNA can include, e.g., mRNA.

The term "expression" refers to the cellular processes involved in producing RNA and proteins and as appropriate, secreting proteins, including where applicable, but not limited to, for example, transcription, transcript processing, translation and protein folding, modification and processing. Expression can refer to the transcription and stable accumulation of sense (e.g., mRNA) or antisense RNA derived from a nucleic acid fragment or fragments and/or to the translation of mRNA into a polypeptide.

As used herein, the term "detecting" or "measuring" refers to observing a signal from, e.g. a probe, label, or target molecule to indicate the presence of an analyte in a sample. Any method known in the art for detecting a particular label moiety can be used for detection. Exemplary detection methods include, but are not limited to, spectroscopic, fluorescent, photochemical, biochemical, immunochemical, electrical, optical or chemical methods. In some embodiments of any of the aspects, measuring can be a quantitative observation.

In some embodiments of any of the aspects, a polypeptide, nucleic acid, or cell as described herein can be engineered. As used herein, "engineered" refers to the aspect of having been manipulated by the hand of man. For example, a polypeptide is considered to be "engineered" when at least one aspect of the polypeptide, e.g., its sequence, has been manipulated by the hand of man to differ from the aspect as it exists in nature. As is common practice and is understood by those in the art, progeny of an engineered cell are typically still referred to as "engineered" even though the actual manipulation was performed on a prior entity.

In some embodiments of any of the aspects, the polypeptides described herein are exogenous. In some embodiments of any of the aspects, the polypeptides described herein are ectopic. In some embodiments of any of the aspects, the polypeptides described herein are not endogenous.

The term "exogenous" refers to a substance present in a cell other than its native source. The term "exogenous" when used herein can refer to a nucleic acid (e.g. a nucleic acid encoding a polypeptide) or a polypeptide that has been introduced by a process involving the hand of man into a biological system such as a cell or organism in which it is not normally found and one wishes to introduce the nucleic acid or polypeptide into such a cell or organism. Alternatively, "exogenous" can refer to a nucleic acid or a polypeptide that has been introduced by a process involving the hand of man into a biological system such as a cell or organism in which it is found in relatively low amounts and one wishes to increase the amount of the nucleic acid or polypeptide in the cell or organism, e.g., to create ectopic expression or levels. In contrast, the term "endogenous" refers to a substance that is native to the biological system or cell. As used herein, "ectopic" refers to a substance that is found in an unusual location and/or amount. An ectopic substance can be one that is normally found in a given cell, but at a much lower amount and/or at a different time. Ectopic also includes substance, such as a polypeptide or nucleic acid that is not naturally found or expressed in a given cell in its natural environment.

As described herein, an "antigen" is a molecule that is bound by a binding site on an antibody agent (e.g., extracellular binding domain). Typically, antigens are bound by antibody ligands and are capable of raising an antibody response in vivo. An antigen can be a polypeptide, protein, nucleic acid or other molecule or portion thereof. The term "antigenic determinant" refers to an epitope on the antigen recognized by an antigen-binding molecule, and more particularly, by the antigen-binding site of said molecule.

In some embodiments, a nucleic acid encoding a polypeptide or polypeptide system as described herein is comprised by a vector. In some of the aspects described herein, a nucleic acid sequence encoding a given polypeptide as described herein, or any module thereof, is operably linked to a vector. The term "vector", as used herein, refers to a nucleic acid construct designed for delivery to a host cell or for transfer between different host cells. As used herein, a vector can be viral or non-viral. The term "vector" encompasses any genetic element that is capable of replication when associated with the proper control elements and that can transfer gene sequences to cells. A vector can include, but is not limited to, a cloning vector, an expression vector, a plasmid, phage, transposon, cosmid, chromosome, virus, virion, etc.

In some embodiments of any of the aspects, the vector is recombinant, e.g., it comprises sequences originating from at least two different sources. In some embodiments of any of the aspects, the vector comprises sequences originating from at least two different species. In some embodiments of any of the aspects, the vector comprises sequences originating from at least two different genes, e.g., it comprises a fusion protein or a nucleic acid encoding an expression product which is operably linked to at least one non-native (e.g., heterologous) genetic control element (e.g., a promoter, suppressor, activator, enhancer, response element, or the like).

As used herein, the term "expression vector" refers to a vector that directs expression of an RNA or polypeptide from sequences linked to transcriptional regulatory sequences on the vector. The sequences expressed will often, but not necessarily, be heterologous to the cell. An expression vector may comprise additional elements, for example, the expression vector may have two replication systems, thus allowing it to be maintained in two organisms, for example in human cells for expression and in a prokaryotic host for cloning and amplification.

As used herein, the term "viral vector" refers to a nucleic acid vector construct that includes at least one element of viral origin and has the capacity to be packaged into a viral vector particle. The viral vector can contain the nucleic acid encoding a polypeptide as described herein in place of non-essential viral genes. The vector and/or particle may be utilized for the purpose of transferring any nucleic acids into cells either in vitro or in vivo. Numerous forms of viral vectors are known in the art. Non-limiting examples of a viral vector of this invention include an AAV vector, an adenovirus vector, a lentivirus vector, a retrovirus vector, a herpesvirus vector, an alphavirus vector, a poxvirus vector a baculovirus vector, and a chimeric virus vector.

It should be understood that the vectors described herein can, in some embodiments, be combined with other suitable compositions and therapies. In some embodiments, the vector is episomal. The use of a suitable episomal vector provides a means of maintaining the nucleotide of interest in the subject in high copy number extra chromosomal DNA thereby eliminating potential effects of chromosomal integration.

As used herein, the terms "treat," "treatment," "treating," or "amelioration" refer to therapeutic treatments, wherein the object is to reverse, alleviate, ameliorate, inhibit, slow down or stop the progression or severity of a condition associated with a disease or disorder, e.g. cancer. The term "treating" includes reducing or alleviating at least one adverse effect or symptom of a condition, disease or disorder associated with the disease or disorder (e.g., cancer). Treatment is generally "effective" if one or more symptoms or clinical markers are reduced. Alternatively, treatment is "effective" if the progression of a disease is reduced or halted. Tat is, "treatment" includes not just the improvement of symptoms or markers, but also a cessation of, or at least slowing of, progress or worsening of symptoms compared to what would be expected in the absence of treatment. Beneficial or desired clinical results include, but are not limited to, alleviation of one or more symptom(s), diminishment of extent of disease, stabilized (i.e., not worsening) state of disease, delay or slowing of disease progression, amelioration or palliation of the disease state, remission (whether partial or total), and/or decreased mortality, whether detectable or undetectable. The term "treatment" of a disease also includes providing relief from the symptoms or side-effects of the disease (including palliative treatment).

As used herein, the term "pharmaceutical composition" refers to the active agent in combination with a pharmaceutically acceptable carrier e.g. a carrier commonly used in the pharmaceutical industry. The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio. In some embodiments of any of the aspects, a pharmaceutically acceptable carrier can be a carrier other than water. In some embodiments of any of the aspects, a pharmaceutically acceptable carrier can be a cream, emulsion, gel, liposome, nanoparticle, and/or ointment. In some embodiments of any of the aspects, a pharmaceutically acceptable carrier can be an artificial or engineered carrier, e.g., a carrier that the active ingredient would not be found to occur in or within nature.

As used herein, the term "administering," refers to the placement of a compound as disclosed herein into a subject by a method or route which results in at least partial delivery of the agent at a desired site. Pharmaceutical compositions comprising the compounds disclosed herein can be administered by any appropriate route which results in an effective treatment in the subject. In some embodiments, administration comprises physical human activity, e.g., an injection, act of ingestion, an act of application, and/or manipulation of a delivery device or machine. Such activity can be performed, e.g., by a medical professional and/or the subject being treated.

As used herein, "contacting" refers to any suitable means for delivering, or exposing, an agent to at least one cell. Exemplary delivery methods include, but are not limited to, direct delivery to cell culture medium, transfection, transduction, perfusion, injection, or other delivery method known to one skilled in the art. In some embodiments, contacting comprises physical human activity, e.g., an injection; an act of dispensing, mixing, and/or decanting; and/or manipulation of a delivery device or machine.

As used herein, the term "analog" refers to a substance that shares one or more particular structural features, elements, components, or moieties with a reference substance. Typically, an "analog" shows significant structural similarity with the reference substance, for example sharing a core or consensus structure, but also differs in certain discrete ways. In some embodiments, an analog is a substance that can be generated from the reference substance, e.g., by chemical manipulation of the reference substance.

The term "statistically significant" or "significantly" refers to statistical significance and generally means a two standard deviation (2SD) or greater difference.

Other than in the operating examples, or where otherwise indicated, all numbers expressing quantities of ingredients or reaction conditions used herein should be understood as modified in all instances by the term "about." The term "about" when used in connection with percentages can mean±1%.

As used herein, the term "comprising" means that other elements can also be present in addition to the defined elements presented. The use of "comprising" indicates inclusion rather than limitation.

The term "consisting of" refers to compositions, methods, and respective components thereof as described herein, which are exclusive of any element not recited in that description of the embodiment.

As used herein the term "consisting essentially of" refers to those elements required for a given embodiment. The term permits the presence of additional elements that do not materially affect the basic and novel or functional characteristic(s) of that embodiment of the invention.

As used herein, the term "corresponding to" refers to an amino acid or nucleotide at the enumerated position in a first polypeptide or nucleic acid, or an amino acid or nucleotide that is equivalent to an enumerated amino acid or nucleotide in a second polypeptide or nucleic acid. Equivalent enumerated amino acids or nucleotides can be determined by alignment of candidate sequences using degree of homology programs known in the art, e.g., BLAST.

As used herein, the term "specific binding" refers to a chemical interaction between two molecules, compounds, cells and/or particles wherein the first entity binds to the second, target entity with greater specificity and affinity than it binds to a third entity which is a non-target. In some embodiments, specific binding can refer to an affinity of the first entity for the second target entity which is at least 10 times, at least 50 times, at least 100 times, at least 500 times, at least 1000 times or greater than the affinity for the third non-target entity. A reagent specific for a given target is one that exhibits specific binding for that target under the conditions of the assay being utilized.

The singular terms "a," "an," and "the" include plural referents unless context clearly indicates otherwise. Similarly, the word "or" is intended to include "and" unless the context clearly indicates otherwise. Although methods and materials similar or equivalent to those described herein can be used in the practice or testing of this disclosure, suitable methods and materials are described below. The abbreviation, "e.g." is derived from the Latin exempli gratia, and is used herein to indicate a non-limiting example. Thus, the abbreviation "e.g." is synonymous with the term "for example."

Groupings of alternative elements or embodiments of the invention disclosed herein are not to be construed as limitations. Each group member can be referred to and claimed individually or in any combination with other members of the group or other elements found herein. One or more members of a group can be included in, or deleted from, a group for reasons of convenience and/or patentability. When any such inclusion or deletion occurs, the specification is herein deemed to contain the group as modified thus fulfilling the written description of all Markush groups used in the appended claims.

Unless otherwise defined herein, scientific and technical terms used in connection with the present application shall have the meanings that are commonly understood by those of ordinary skill in the art to which this disclosure belongs. It should be understood that this invention is not limited to the particular methodology, protocols, and reagents, etc., described herein and as such can vary. The terminology used herein is for the purpose of describing particular embodiments only, and is not intended to limit the scope of the present invention, which is defined solely by the claims. Definitions of common terms in immunology and molecular biology can be found in The Merck Manual of Diagnosis and Therapy, 20th Edition, published by Merck Sharp & Dohme Corp., 2018 (ISBN 0911910190, 978-0911910421); Robert S. Porter et al. (eds.), The Encyclopedia of Molecular Cell Biology and Molecular Medicine, published by Blackwell Science Ltd., 1999-2012 (ISBN 9783527600908); and Robert A. Meyers (ed.), Molecular Biology and Biotechnology: a Comprehensive Desk Reference, published by VCH Publishers, Inc., 1995 (ISBN 1-56081-569-8); Immunology by Werner Luttmann, published by Elsevier, 2006; Janeway's Immunobiology, Kenneth Murphy, Allan Mowat, Casey Weaver (eds.), W. W. Norton & Company, 2016 (ISBN 0815345054, 978-0815345053); Lewin's Genes XI, published by Jones & Bartlett Publishers, 2014 (ISBN-1449659055); Michael Richard Green and Joseph Sambrook, Molecular Cloning: A Laboratory Manual, 4th ed., Cold Spring Harbor Laboratory Press, Cold Spring Harbor, N.Y., USA (2012) (ISBN 1936113414); Davis et al., Basic Methods in Molecular Biology, Elsevier Science Publishing, Inc., New York, USA (2012) (ISBN 044460149X); Laboratory Methods in Enzymology: DNA, Jon Lorsch (ed.) Elsevier, 2013 (ISBN 0124199542); Current Protocols in Molecular Biology (CPMB), Frederick M. Ausubel (ed.), John Wiley and Sons, 2014 (ISBN 047150338X, 9780471503385), Current Protocols in Protein Science (CPPS), John E. Coligan (ed.), John Wiley and Sons, Inc., 2005; and Current Protocols in Immunology (CPI) (John E. Coligan, ADA M Kruisbeek, David H Margulies, Ethan M Shevach, Warren Strobe, (eds.) John Wiley and Sons, Inc., 2003 (ISBN 0471142735, 9780471142737), US Patent Publications US20180163195, US20180346589, US20200308234, US20200377564; International Patent Publications WO2018111838, WO2018222880, WO2020205510, WO2020232366, the contents of which are all incorporated by reference herein in their entireties.

One of skill in the art can readily identify a chemotherapeutic agent of use (e.g. see Physicians' Cancer Chemotherapy Drug Manual 2014, Edward Chu, Vincent T. DeVita Jr., Jones & Bartlett Learning; Principles of Cancer Therapy, Chapter 85 in Harrison's Principles of Internal Medicine, 18th edition; Therapeutic Targeting of Cancer Cells: Era of Molecularly Targeted Agents and Cancer Pharmacology, Chs. 28-29 in Abeloff's Clinical Oncology, 2013 Elsevier; and Fischer D S (ed): The Cancer Chemotherapy Handbook, 4th ed. St. Louis, Mosby-Year Book, 2003).

In some embodiments of any of the aspects, the disclosure described herein does not concern a process for cloning human beings, processes for modifying the germ line genetic identity of human beings, uses of human embryos for industrial or commercial purposes or processes for modifying the genetic identity of animals which are likely to cause them suffering without any substantial medical benefit to man or animal, and also animals resulting from such processes.

Other terms are defined herein within the description of the various aspects of the invention.

All patents and other publications; including literature references, issued patents, published patent applications, and co-pending patent applications; cited throughout this application are expressly incorporated herein by reference for the purpose of describing and disclosing, for example, the methodologies described in such publications that might be used in connection with the technology described herein. These publications are provided solely for their disclosure prior to the filing date of the present application. Nothing in this regard should be construed as an admission that the inventors are not entitled to antedate such disclosure by virtue of prior invention or for any other reason. All statements as to the date or representation as to the contents of these documents is based on the information available to the applicants and does not constitute any admission as to the correctness of the dates or contents of these documents.

The description of embodiments of the disclosure is not intended to be exhaustive or to limit the disclosure to the precise form disclosed. While specific embodiments of, and examples for, the disclosure are described herein for illustrative purposes, various equivalent modifications are possible within the scope of the disclosure, as those skilled in the relevant art will recognize. For example, while method steps or functions are presented in a given order, alternative embodiments may perform functions in a different order, or functions may be performed substantially concurrently. The teachings of the disclosure provided herein can be applied to other procedures or methods as appropriate. The various embodiments described herein can be combined to provide further embodiments. Aspects of the disclosure can be modified, if necessary, to employ the compositions, functions and concepts of the above references and application to provide yet further embodiments of the disclosure. Moreover, due to biological functional equivalency considerations, some changes can be made in protein structure without affecting the biological or chemical action in kind or amount. These and other changes can be made to the disclosure in light of the detailed description. All such modifications are intended to be included within the scope of the appended claims.

Specific elements of any of the foregoing embodiments can be combined or substituted for elements in other embodiments. Furthermore, while advantages associated with certain embodiments of the disclosure have been described in the context of these embodiments, other embodiments may also exhibit such advantages, and not all embodiments need necessarily exhibit such advantages to fall within the scope of the disclosure.

The technology described herein is further illustrated by the following examples which in no way should be construed as being further limiting.

Some embodiments of the technology described herein can be defined according to any of the following numbered paragraphs:

1. An inducible split-nuclease polypeptide system comprising:
   a) a first polypeptide comprising:
      i) a first member of an inducible dimerization domain ($D^1$); and
      ii) a first polypeptide fragment of a sequence-specific nuclease ($N^1$); and
   b) a second polypeptide comprising:
      i) a second member of the inducible dimerization domain ($D^2$); and
      ii) a second polypeptide fragment of the sequence-specific nuclease ($N^2$); and
   wherein the first and second members of the inducible dimerization domain come together in the presence of an inducer agent or inducer signal, resulting in protein complementation of the two nuclease polypeptide fragments to form the active nuclease protein in the presence of the inducer agent or inducer signal.
2. The system of paragraph 1, wherein there is a lag time of 30 seconds or less in between protein complementation of the two nuclease polypeptide fragments in the presence of the inducer agent or inducer signal and the nuclease protein being in its active state.
3. The system of paragraph 1, wherein $D^1$ and $D^2$ are selected from the group consisting of:
   a) $D^1$ and $D^2$ each comprising a VHH camelid antibody that specifically binds to caffeine (CaffVHH);
   b) $D^1$ and $D^2$ each comprising a tandem VHH camelid antibody that specifically binds to caffeine (tandem CaffVHH);
   c) $D^1$ comprising a GID1 domain or a fragment thereof, and $D^2$ comprising a GAI domain, wherein the GID1 domain and GAI domain bind to the inducer agent Gibberellin Ester (GIB);
   d) $D^2$ comprising a GID1 domain or a fragment thereof, and $D^1$ comprising a GAI domain, wherein the GID1 domain and GAI domain bind to the inducer agent Gibberellin Ester (GIB);
   e) $D^1$ comprising a FKBP domain or a fragment thereof, and $D^2$ comprising a FRB domain, wherein the FKBP domain and FRB domain bind to the inducer agent Rapalog (RAP);
   f) $D^2$ comprising a FKBP domain or a fragment thereof, and $D^1$ comprising a FRB domain, wherein the FKBP domain and FRB domain bind to the inducer agent Rapalog (RAP);
   g) $D^1$ comprising a PYL domain or a fragment thereof, and $D^2$ comprising an ABI domain, wherein the PYL domain and ABI domain bind to the inducer agent Abscisic acid (ABA);
   h) $D^2$ comprising a PYL domain or a fragment thereof, and $D^1$ comprising an ABI domain, wherein the PYL domain and ABI domain bind to the inducer agent Abscisic acid (ABA);
   i) $D^1$ comprising a Light-inducible dimerization domain (LIDD), wherein a LIDD dimerizes with a complementary LIDD ($D^2$) upon exposure to a light inducer signal of an appropriate wavelength;
   j) $D^2$ comprising a Light-inducible dimerization domain (LIDD), wherein a LIDD dimerizes with a complementary LIDD ($D^1$) upon exposure to a light inducer signal of an appropriate wavelength;
   k) $D^1$ comprises a repressible protease and $D^2$ comprises a reader domain, wherein the reader domain specifically binds to a repressible protease in the presence of a specific protease inhibitor; and l) $D^2$ comprises a repressible protease and $D^1$ comprises a reader domain, wherein the reader domain specifically binds to a repressible protease in the presence of a specific protease inhibitor.

4. The system of paragraph 3, wherein:
   a) the repressible protease is hepatitis C virus (HCV) nonstructural protein 3 (NS3);
   b) the reader domain is DNCR and the protease inhibitor is danoprevir; and/or
   c) the reader domain is GNCR and the protease inhibitor is grazoprevir.

5. The system of paragraph 1, wherein the first ($N^1$) and second ($N^2$) nuclease polypeptide fragments are Cas13d endonuclease polypeptide fragments, wherein $N^1$ and $N^2$ are selected from the group consisting of:
   a) $N^1$ comprises a N-terminal polypeptide fragment of SEQ ID NO: 1 with the C-terminus ending at amino acid 88 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 89 of SEQ ID NO: 1 or a polypeptide that is at least 95% identical to SEQ ID NO: 1;
   b) $N^1$ comprises a N-terminal polypeptide fragment of SEQ ID NO: 1 with the C-terminus ending at amino acid 263 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 264 of SEQ ID NO: 1 or a polypeptide that is at least 95% identical to SEQ ID NO: 1;
   c) $N^1$ comprises a N-terminal polypeptide fragment of SEQ ID NO: 1 with the C-terminus ending at amino acid 384 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 385 of SEQ ID NO: 1 or a polypeptide that is at least 95% identical to SEQ ID NO: 1;
   d) $N^1$ comprises a N-terminal polypeptide fragment of SEQ ID NO: 1 with the C-terminus ending at amino acid 404 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 405 of SEQ ID NO: 1 or a polypeptide that is at least 95% identical to SEQ ID NO: 1;
   e) $N^1$ comprises a N-terminal polypeptide fragment of SEQ ID NO: 1 with the C-terminus ending at amino acid 507 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 508 of SEQ ID NO: 1 or a polypeptide that is at least 95% identical to SEQ ID NO: 1;
   f) $N^1$ comprises a N-terminal polypeptide fragment of SEQ ID NO: 1 with the C-terminus ending at amino acid 559 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 560 of SEQ ID NO: 1 or a polypeptide that is at least 95% identical to SEQ ID NO: 1;
   g) $N^1$ comprises a N-terminal polypeptide fragment of SEQ ID NO: 1 with the C-terminus ending at amino acid 565 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 566 of SEQ ID NO: 1 or a polypeptide that is at least 95% identical to SEQ ID NO: 1;
   h) $N^1$ comprises a N-terminal polypeptide fragment of SEQ ID NO: 1 with the C-terminus ending at amino acid 576 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 577 of SEQ ID NO: 1 or a polypeptide that is at least 95% identical to SEQ ID NO: 1;
   i) $N^1$ comprises a N-terminal polypeptide fragment of SEQ ID NO: 1 with the C-terminus ending at amino acid 655 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 656 of SEQ ID NO: 1 or a polypeptide that is at least 95% identical to SEQ ID NO: 1; and
   j) $N^1$ comprises a N-terminal polypeptide fragment of SEQ ID NO: 1 with the C-terminus ending at amino acid 903 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 904 of SEQ ID NO: 1 or a polypeptide that is at least 95% identical to SEQ ID NO: 1.

6. The system of paragraph 1, wherein the first ($N^1$) and second ($N^2$) nuclease polypeptide fragments are Cas13a endonuclease polypeptide fragments, wherein $N^1$ and $N^2$ are selected from the group consisting of:
   a) $N^1$ comprises a N-terminal polypeptide fragment of SEQ ID NO: 2 with the C-terminus ending at amino acid 416 of SEQ ID NO: 2 or a polypeptide that is at least 95% identical to SEQ ID NO: 2, and $N^2$ comprises a C-terminal polypeptide fragment of SEQ ID NO: 2 with the N-terminus beginning at amino acid 417 of SEQ ID NO: 2 or a polypeptide that is at least 95% identical to SEQ ID NO: 2; and
   b) $N^1$ comprises a N-terminal polypeptide fragment of SEQ ID NO: 2 with the C-terminus ending at amino acid 421 of SEQ ID NO: 2 or a polypeptide that is at least 95% identical to SEQ ID NO: 2, and $N^2$ comprises a C-terminal polypeptide fragment of SEQ ID NO: 2 with the N-terminus beginning at amino acid 422 of SEQ ID NO: 2 or a polypeptide that is at least 95% identical to SEQ ID NO: 2.

7. The system of paragraph 1, wherein the first ($N^1$) and second ($N^2$) nuclease polypeptide fragments are Cas13b endonuclease polypeptide fragments, wherein $N^1$ and $N^2$ are selected from the group consisting of:
   a) $N^1$ comprises a N-terminal polypeptide fragment of SEQ ID NO: 3 with the C-terminus ending at amino acid 49 of SEQ ID NO: 3 or a polypeptide that is at least 95% identical to SEQ ID NO: 3, and $N^2$ comprises a C-terminal polypeptide fragment of SEQ ID NO: 3 with the N-terminus beginning at amino acid 50 of SEQ ID NO: 3 or a polypeptide that is at least 95% identical to SEQ ID NO: 3;
   b) $N^1$ comprises a N-terminal polypeptide fragment of SEQ ID NO: 3 with the C-terminus ending at amino acid 177 of SEQ ID NO: 3 or a polypeptide that is at least 95% identical to SEQ ID NO: 3, and $N^2$ comprises a C-terminal polypeptide fragment of SEQ ID NO: 3 with the N-terminus beginning at amino acid 178 of SEQ ID NO: 3 or a polypeptide that is at least 95% identical to SEQ ID NO: 3;

c) $N^1$ comprises a N-terminal polypeptide fragment of SEQ ID NO: 3 with the C-terminus ending at amino acid 250 of SEQ ID NO: 3 or a polypeptide that is at least 95% identical to SEQ ID NO: 3, and $N^2$ comprises a C-terminal polypeptide fragment of SEQ ID NO: 3 with the N-terminus beginning at amino acid 251 of SEQ ID NO: 3 or a polypeptide that is at least 95% identical to SEQ ID NO: 3;

d) $N^1$ comprises a N-terminal polypeptide fragment of SEQ ID NO: 3 with the C-terminus ending at amino acid 431 of SEQ ID NO: 3 or a polypeptide that is at least 95% identical to SEQ ID NO: 3, and $N^2$ comprises a C-terminal polypeptide fragment of SEQ ID NO: 3 with the N-terminus beginning at amino acid 432 of SEQ ID NO: 3 or a polypeptide that is at least 95% identical to SEQ ID NO: 3; and e) $N^1$ comprises a N-terminal polypeptide fragment of SEQ ID NO: 3 with the C-terminus ending at amino acid 1065 of SEQ ID NO: 3 or a polypeptide that is at least 95% identical to SEQ ID NO: 3, and $N^2$ comprises a C-terminal polypeptide fragment of SEQ ID NO: 3 with the N-terminus beginning at amino acid 1066 of SEQ ID NO: 3 or a polypeptide that is at least 95% identical to SEQ ID NO: 3.

8. The system of paragraph 1, wherein the first and/or second polypeptide further comprises:
a) at least one cytosolic sequestering domain, wherein the cytosolic sequestering domain comprises a ligand binding domain (LBD), wherein, in the presence of a ligand, the sequestering of the protein to the cytosol is inhibited;
b) at least one nuclear export signal (NES); or
c) at least one nuclear localization signal (NLS).

9. An inducible split-recombinase polypeptide system comprising:
a) a first polypeptide comprising:
  i) a first member of an inducible dimerization domain ($D^1$); and
  ii) a first polypeptide fragment of a recombinase ($R^1$); and
b) a second polypeptide comprising:
  i) a second member of the inducible dimerization domain ($D^2$); and
  ii) a second polypeptide fragment of the recombinase ($R^2$); and
wherein the first and second members of the inducible dimerization domain come together in the presence of an inducer agent or inducer signal, resulting in protein complementation of the two recombinase polypeptide fragments to form the active recombinase protein in the presence of the inducer agent or inducer signal.

10. The system of paragraph 9, wherein there is a lag time of 30 seconds or less in between protein complementation of the two recombinase polypeptide fragments in the presence of the inducer agent or inducer signal and the recombinase protein being in its active state.

11. The system of paragraph 9, wherein $D^1$ and $D^2$ are selected from the group consisting of:
a) $D^1$ and $D^2$ each comprising a VHH camelid antibody that specifically binds to caffeine (CaffVHH);
b) $D^1$ and $D^2$ each comprising a tandem VHH camelid antibody that specifically binds to caffeine (tandem CaffVHH);
c) $D^1$ comprising a GID1 domain or a fragment thereof, and $D^2$ comprising a GAI domain, wherein the GID1 domain and GAI domain bind to the inducer agent Gibberellin Ester (GIB);
d) $D^2$ comprising a GID1 domain or a fragment thereof, and $D^1$ comprising a GAI domain, wherein the GID1 domain and GAI domain bind to the inducer agent Gibberellin Ester (GIB);
e) $D^1$ comprising a FKBP domain or a fragment thereof, and $D^2$ comprising a FRB domain, wherein the FKBP domain and FRB domain bind to the inducer agent Rapalog (RAP);
f) $D^2$ comprising a FKBP domain or a fragment thereof, and $D^1$ comprising a FRB domain, wherein the FKBP domain and FRB domain bind to the inducer agent Rapalog (RAP);
g) $D^1$ comprising a PYL domain or a fragment thereof, and $D^2$ comprising an ABI domain, wherein the PYL domain and ABI domain bind to the inducer agent Abscisic acid (ABA);
h) $D^2$ comprising a PYL domain or a fragment thereof, and $D^1$ comprising an ABI domain, wherein the PYL domain and ABI domain bind to the inducer agent Abscisic acid (ABA);
i) $D^1$ comprising a Light-inducible dimerization domain (LIDD), wherein a LIDD dimerizes with a complementary LIDD ($D^2$) upon exposure to a light inducer signal of an appropriate wavelength;
j) $D^2$ comprising a Light-inducible dimerization domain (LIDD), wherein a LIDD dimerizes with a complementary LIDD ($D^1$) upon exposure to a light inducer signal of an appropriate wavelength;
k) $D^1$ comprises a repressible protease and $D^2$ comprises a reader domain, wherein the reader domain specifically binds to a repressible protease in the presence of a specific protease inhibitor; and
l) $D^2$ comprises a repressible protease and $D^1$ comprises a reader domain, wherein the reader domain specifically binds to a repressible protease in the presence of a specific protease inhibitor.

12. The system of paragraph 11, wherein:
a) the repressible protease is hepatitis C virus (HCV) nonstructural protein 3 (NS3);
b) the reader domain is DNCR and the protease inhibitor is danoprevir; and/or
c) the reader domain is GNCR and the protease inhibitor is grazoprevir.

13. The system of paragraph 9, wherein the first ($R^1$) and second ($R^2$) recombinase polypeptide fragments are Cre recombinase polypeptide fragments, wherein $R^1$ and $R^2$ are selected from the group consisting of:
a) $R^1$ comprises a N-terminal polypeptide fragment of SEQ ID NO: 1 with the C-terminus ending at amino acid 229 of SEQ ID NO: 58 or a polypeptide that is at least 95% identical to SEQ ID NO: 58, and $R^2$ comprises a C-terminal polypeptide fragment of SEQ ID NO: 1 with the N-terminus beginning at amino acid 230 of SEQ ID NO: 58 or a polypeptide that is at least 95% identical to SEQ ID NO: 58;
b) $R^1$ comprises a N-terminal polypeptide fragment of SEQ ID NO: 1 with the C-terminus ending at amino acid 251 of SEQ ID NO: 58 or a polypeptide that is at least 95% identical to SEQ ID NO: 58, and $R^2$ comprises a C-terminal polypeptide fragment of SEQ ID NO: 1 with the N-terminus beginning at amino acid 252 of SEQ ID NO: 58 or a polypeptide that is at least 95% identical to SEQ ID NO: 58;

c) R¹ comprises a N-terminal polypeptide fragment of SEQ ID NO: 1 with the C-terminus ending at amino acid 256 of SEQ ID NO: 58 or a polypeptide that is at least 95% identical to SEQ ID NO: 58, and R² comprises a C-terminal polypeptide fragment of SEQ ID NO: 58 with the N-terminus beginning at amino acid 257 of SEQ ID NO: 58 or a polypeptide that is at least 95% identical to SEQ ID NO: 58; and d) R¹ comprises a N-terminal polypeptide fragment of SEQ ID NO: 1 with the C-terminus ending at amino acid 270 of SEQ ID NO: 58 or a polypeptide that is at least 95% identical to SEQ ID NO: 58, and R² comprises a C-terminal polypeptide fragment of SEQ ID NO: 1 with the N-terminus beginning at amino acid 271 of SEQ ID NO: 58 or a polypeptide that is at least 95% identical to SEQ ID NO: 58.

14. The system of paragraph 9, wherein the first (R¹) and second (R²) recombinase polypeptide fragments are Flp recombinase polypeptide fragments, wherein R¹ and R² are selected from the group consisting of:

a) R¹ comprises a N-terminal polypeptide fragment of SEQ ID NO: 60 with the C-terminus ending at amino acid 27 of SEQ ID NO: 60 or a polypeptide that is at least 95% identical to SEQ ID NO: 60, and R² comprises a C-terminal polypeptide fragment of SEQ ID NO: 60 with the N-terminus beginning at amino acid 28 of SEQ ID NO: 60 or a polypeptide that is at least 95% identical to SEQ ID NO: 60;

b) R¹ comprises a N-terminal polypeptide fragment of SEQ ID NO: 60 with the C-terminus ending at amino acid 168 of SEQ ID NO: 60 or a polypeptide that is at least 95% identical to SEQ ID NO: 60, and R² comprises a C-terminal polypeptide fragment of SEQ ID NO: 60 with the N-terminus beginning at amino acid 169 of SEQ ID NO: 60 or a polypeptide that is at least 95% identical to SEQ ID NO: 60;

c) R¹ comprises a N-terminal polypeptide fragment of SEQ ID NO: 60 with the C-terminus ending at amino acid 374 of SEQ ID NO: 60 or a polypeptide that is at least 95% identical to SEQ ID NO: 60, and R² comprises a C-terminal polypeptide fragment of SEQ ID NO: 60 with the N-terminus beginning at amino acid 375 of SEQ ID NO: 60 or a polypeptide that is at least 95% identical to SEQ ID NO: 60; and d) R¹ comprises a N-terminal polypeptide fragment of SEQ ID NO: 60 with the C-terminus ending at amino acid 396 of SEQ ID NO: 60 or a polypeptide that is at least 95% identical to SEQ ID NO: 60, and R² comprises a C-terminal polypeptide fragment of SEQ ID NO: 60 with the N-terminus beginning at amino acid 397 of SEQ ID NO: 60 or a polypeptide that is at least 95% identical to SEQ ID NO: 60.

15. The system of paragraph 9, wherein the first (R¹) and second (R²) recombinase polypeptide fragments are PhiC recombinase polypeptide fragments, wherein R¹ and R² are selected from the group consisting of:

a) R¹ comprises a N-terminal polypeptide fragment of SEQ ID NO: 62 with the C-terminus ending at amino acid 233 of SEQ ID NO: 62 or a polypeptide that is at least 95% identical to SEQ ID NO: 62, and R² comprises a C-terminal polypeptide fragment of SEQ ID NO: 62 with the N-terminus beginning at amino acid 234 of SEQ ID NO: 62 or a polypeptide that is at least 95% identical to SEQ ID NO: 62;

b) R¹ comprises a N-terminal polypeptide fragment of SEQ ID NO: 62 with the C-terminus ending at amino acid 396 of SEQ ID NO: 62 or a polypeptide that is at least 95% identical to SEQ ID NO: 62, and R² comprises a C-terminal polypeptide fragment of SEQ ID NO: 62 with the N-terminus beginning at amino acid 397 of SEQ ID NO: 62 or a polypeptide that is at least 95% identical to SEQ ID NO: 62;

c) R¹ comprises a N-terminal polypeptide fragment of SEQ ID NO: 62 with the C-terminus ending at amino acid 428 of SEQ ID NO: 62 or a polypeptide that is at least 95% identical to SEQ ID NO: 62, and R² comprises a C-terminal polypeptide fragment of SEQ ID NO: 62 with the N-terminus beginning at amino acid 429 of SEQ ID NO: 62 or a polypeptide that is at least 95% identical to SEQ ID NO: 62; and d) R¹ comprises a N-terminal polypeptide fragment of SEQ ID NO: 62 with the C-terminus ending at amino acid 571 of SEQ ID NO: 62 or a polypeptide that is at least 95% identical to SEQ ID NO: 62, and R² comprises a C-terminal polypeptide fragment of SEQ ID NO: 62 with the N-terminus beginning at amino acid 572 of SEQ ID NO: 62 or a polypeptide that is at least 95% identical to SEQ ID NO: 62.

16. The system of paragraph 9, wherein the first (R¹) and second (R²) recombinase polypeptide fragments are vCre recombinase polypeptide fragments, wherein R¹ and R² are selected from the group consisting of:

a) R¹ comprises a N-terminal polypeptide fragment of SEQ ID NO: 65 with the C-terminus ending at amino acid 82 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 83 of SEQ ID NO: 65 or a polypeptide that is at least 95% identical to SEQ ID NO: 65;

b) R¹ comprises a N-terminal polypeptide fragment of SEQ ID NO: 65 with the C-terminus ending at amino acid 172 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 173 of SEQ ID NO: 65 or a polypeptide that is at least 95% identical to SEQ ID NO: 65;

c) R¹ comprises a N-terminal polypeptide fragment of SEQ ID NO: 65 with the C-terminus ending at amino acid 210 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 211 of SEQ ID NO: 65 or a polypeptide that is at least 95% identical to SEQ ID NO: 65;

d) R¹ comprises a N-terminal polypeptide fragment of SEQ ID NO: 65 with the C-terminus ending at amino acid 269 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 270 of SEQ ID NO: 65 or a polypeptide that is at least 95% identical to SEQ ID NO: 65; and e) R¹ comprises a N-terminal polypeptide fragment of SEQ ID NO: 65 with the C-terminus ending at amino acid 277 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 278 SEQ ID NO: 65 or a polypeptide that is at least 95% identical to SEQ ID NO: 65.

17. The system of paragraph 9, wherein the first and/or second polypeptide further comprises:
   a) at least one cytosolic sequestering domain, wherein the cytosolic sequestering domain comprises a ligand binding domain (LBD), wherein, in the presence of a ligand, the sequestering of the protein to the cytosol is inhibited;
   b) at least one nuclear export signal (NES); or
   c) at least one nuclear localization signal (NLS).
18. A repressible split-nuclease polypeptide system comprising:
   a) a first polypeptide comprising:
      i) a first member of a repressible dimerization domain ($RD^1$); and
      ii) a first polypeptide fragment of a sequence-specific nuclease ($N^1$); and
   b) a second polypeptide comprising:
      i) a second member of the repressible dimerization domain ($RD^2$); and
      ii) a second polypeptide fragment of the sequence-specific nuclease ($N^2$); and
   wherein the first and second members of the repressible dimerization domain come together in the absence of a repressor agent or target signal, resulting in protein complementation of the two nuclease polypeptide fragments to form the active nuclease protein in the absence of the repressor agent or repressor signal;
   wherein the first and second members of the repressible dimerization domain do not come together in the presence of the repressor agent or repressor signal, resulting in no protein complementation of the two nuclease polypeptide fragments and no formation of the active nuclease protein in the presence of the repressor agent or repressor signal.
19. The system of paragraph 18, wherein:
   a) $RD^1$ comprises a repressible protease and $RD^2$ comprises a peptide domain; or
   b) $RD^2$ comprises a repressible protease and $RD^1$ comprises a peptide domain;
      wherein the repressible protease specifically binds to the peptide domain in the absence of a specific protease inhibitor, wherein the repressible protease does not specifically bind to the peptide domain in the presence of a specific protease inhibitor.
20. The system of paragraph 19, wherein:
   a) the repressible protease is hepatitis C virus (HCV) nonstructural protein 3 (NS3);
   b) the peptide domain comprises ANR peptide SEQ ID NO: 170) or CP5-46-5D5E peptide (SEQ ID NO: 171); and/or
   c) the protease inhibitor is selected from grazoprevir, danoprevir, simeprevir, asunaprevir, ciluprevir, boceprevir, sovaprevir, paritaprevir, ombitasvir, paritaprevir, ritonavir, dasabuvir, and telaprevir.
21. The system of paragraph 18, wherein the first ($N^1$) and second ($N^2$) nuclease polypeptide fragments are Cas13d endonuclease polypeptide fragments, wherein $N^1$ and $N^2$ are selected from the group consisting of:
   a) $N^1$ comprises a N-terminal polypeptide fragment of SEQ ID NO: 1 with the C-terminus ending at amino acid 88 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 89 of SEQ ID NO: 1 or a polypeptide that is at least 95% identical to SEQ ID NO: 1;
   b) $N^1$ comprises a N-terminal polypeptide fragment of SEQ ID NO: 1 with the C-terminus ending at amino acid 263 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 264 of SEQ ID NO: 1 or a polypeptide that is at least 95% identical to SEQ ID NO: 1;
   c) $N^1$ comprises a N-terminal polypeptide fragment of SEQ ID NO: 1 with the C-terminus ending at amino acid 384 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 385 of SEQ ID NO: 1 or a polypeptide that is at least 95% identical to SEQ ID NO: 1;
   d) $N^1$ comprises a N-terminal polypeptide fragment of SEQ ID NO: 1 with the C-terminus ending at amino acid 404 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 405 of SEQ ID NO: 1 or a polypeptide that is at least 95% identical to SEQ ID NO: 1;
   e) $N^1$ comprises a N-terminal polypeptide fragment of SEQ ID NO: 1 with the C-terminus ending at amino acid 507 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 508 of SEQ ID NO: 1 or a polypeptide that is at least 95% identical to SEQ ID NO: 1;
   f) $N^1$ comprises a N-terminal polypeptide fragment of SEQ ID NO: 1 with the C-terminus ending at amino acid 559 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 560 of SEQ ID NO: 1 or a polypeptide that is at least 95% identical to SEQ ID NO: 1;
   g) $N^1$ comprises a N-terminal polypeptide fragment of SEQ ID NO: 1 with the C-terminus ending at amino acid 565 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 566 of SEQ ID NO: 1 or a polypeptide that is at least 95% identical to SEQ ID NO: 1;
   h) $N^1$ comprises a N-terminal polypeptide fragment of SEQ ID NO: 1 with the C-terminus ending at amino acid 576 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 577 of SEQ ID NO: 1 or a polypeptide that is at least 95% identical to SEQ ID NO: 1;
   i) $N^1$ comprises a N-terminal polypeptide fragment of SEQ ID NO: 1 with the C-terminus ending at amino acid 655 of SEQ ID NO: 1 or a polypeptide that is at least 95% identical to SEQ ID NO: 1, and $N^2$ comprises a C-terminal polypeptide fragment of SEQ ID NO: 1 with the N-terminus beginning at amino acid 656 of SEQ ID NO: 1 or a polypeptide that is at least 95% identical to SEQ ID NO: 1; and
   j) $N^1$ comprises a N-terminal polypeptide fragment of SEQ ID NO: 1 with the C-terminus ending at amino acid 903 of SEQ ID NO: 1 or a polypeptide that is at least 95% identical to SEQ ID NO: 1, and N² comprises a C-terminal polypeptide fragment of SEQ ID NO: 1 with the N-terminus beginning at amino acid 904 of SEQ ID NO: 1 or a polypeptide that is at least 95% identical to SEQ ID NO: 1.

22. The system of paragraph 18, wherein the first (N¹) and second (N²) nuclease polypeptide fragments are Cas13a endonuclease polypeptide fragments, wherein N¹ and N² are selected from the group consisting of:
  a) N¹ comprises a N-terminal polypeptide fragment of SEQ ID NO: 2 with the C-terminus ending at amino acid 416 of SEQ ID NO: 2 or a polypeptide that is at least 95% identical to SEQ ID NO: 2, and N² comprises a C-terminal polypeptide fragment of SEQ ID NO: 2 with the N-terminus beginning at amino acid 417 of SEQ ID NO: 2 or a polypeptide that is at least 95% identical to SEQ ID NO: 2; and
  b) N¹ comprises a N-terminal polypeptide fragment of SEQ ID NO: 2 with the C-terminus ending at amino acid 421 of SEQ ID NO: 2 or a polypeptide that is at least 95% identical to SEQ ID NO: 2, and N² comprises a C-terminal polypeptide fragment of SEQ ID NO: 2 with the N-terminus beginning at amino acid 422 of SEQ ID NO: 2 or a polypeptide that is at least 95% identical to SEQ ID NO: 2.

23. The system of paragraph 18, wherein the first (N¹) and second (N²) nuclease polypeptide fragments are Cas13b endonuclease polypeptide fragments, wherein N¹ and N² are selected from the group consisting of:
  a) N¹ comprises a N-terminal polypeptide fragment of SEQ ID NO: 3 with the C-terminus ending at amino acid 49 of SEQ ID NO: 3 or a polypeptide that is at least 95% identical to SEQ ID NO: 3, and N² comprises a C-terminal polypeptide fragment of SEQ ID NO: 3 with the N-terminus beginning at amino acid 50 of SEQ ID NO: 3 or a polypeptide that is at least 95% identical to SEQ ID NO: 3;
  b) N¹ comprises a N-terminal polypeptide fragment of SEQ ID NO: 3 with the C-terminus ending at amino acid 177 of SEQ ID NO: 3 or a polypeptide that is at least 95% identical to SEQ ID NO: 3, and N² comprises a C-terminal polypeptide fragment of SEQ ID NO: 3 with the N-terminus beginning at amino acid 178 of SEQ ID NO: 3 or a polypeptide that is at least 95% identical to SEQ ID NO: 3;
  c) N¹ comprises a N-terminal polypeptide fragment of SEQ ID NO: 3 with the C-terminus ending at amino acid 250 of SEQ ID NO: 3 or a polypeptide that is at least 95% identical to SEQ ID NO: 3, and N² comprises a C-terminal polypeptide fragment of SEQ ID NO: 3 with the N-terminus beginning at amino acid 251 of SEQ ID NO: 3 or a polypeptide that is at least 95% identical to SEQ ID NO: 3;
  d) N¹ comprises a N-terminal polypeptide fragment of SEQ ID NO: 3 with the C-terminus ending at amino acid 431 of SEQ ID NO: 3 or a polypeptide that is at least 95% identical to SEQ ID NO: 3, and N² comprises a C-terminal polypeptide fragment of SEQ ID NO: 3 with the N-terminus beginning at amino acid 432 of SEQ ID NO: 3 or a polypeptide that is at least 95% identical to SEQ ID NO: 3; and
  e) N¹ comprises a N-terminal polypeptide fragment of SEQ ID NO: 3 with the C-terminus ending at amino acid 1065 of SEQ ID NO: 3 or a polypeptide that is at least 95% identical to SEQ ID NO: 3, and N² comprises a C-terminal polypeptide fragment of SEQ ID NO: 3 with the N-terminus beginning at amino acid 1066 of SEQ ID NO: 3 or a polypeptide that is at least 95% identical to SEQ ID NO: 3.

24. A repressible split-recombinase polypeptide system comprising:
  a) a first polypeptide comprising:
    i) a first member of a repressible dimerization domain (RD¹); and
    ii) a first polypeptide fragment of a recombinase (R¹); and
  b) a second polypeptide comprising:
    i) a second member of the repressible dimerization domain (RD²); and
    ii) a second polypeptide fragment of the recombinase (R²); and
  wherein the first and second members of the repressible dimerization domain come together in the absence of a repressor agent or repressor signal, resulting in protein complementation of the two recombinase polypeptide fragments to form the active recombinase protein in the absence of the repressor agent or repressor signal;
  wherein the first and second members of the repressible dimerization domain do not come together in the presence of the repressor agent or repressor signal, resulting in no protein complementation of the two recombinase polypeptide fragments and no formation of the active recombinase protein in the presence of the repressor agent or repressor signal.

25. The system of paragraph 24, wherein:
  a) RD¹ comprises a repressible protease and RD² comprises a peptide domain; or
  b) RD² comprises a repressible protease and RD¹ comprises a peptide domain;
    wherein the repressible protease specifically binds to the peptide domain in the absence of a specific protease inhibitor, wherein the repressible protease does not specifically bind to the peptide domain in the presence of a specific protease inhibitor.

26. The system of paragraph 25, wherein:
  a) the repressible protease is hepatitis C virus (HCV) nonstructural protein 3 (NS3);
  b) the peptide domain comprises ANR peptide SEQ ID NO: 170) or CP5-46-5D5E peptide (SEQ ID NO: 171); and/or
  c) the protease inhibitor is selected from grazoprevir, danoprevir, simeprevir, asunaprevir, ciluprevir, boceprevir, sovaprevir, paritaprevir, ombitasvir, paritaprevir, ritonavir, dasabuvir, and telaprevir.

27. The system of paragraph 24, wherein the first (R¹) and second (R²) recombinase polypeptide fragments are Cre recombinase polypeptide fragments, wherein R¹ and R² are selected from the group consisting of:
  a) R¹ comprises a N-terminal polypeptide fragment of SEQ ID NO: 1 with the C-terminus ending at amino acid 229 of SEQ ID NO: 58 or a polypeptide that is at least 95% identical to SEQ ID NO: 58, and R² comprises a C-terminal polypeptide fragment of SEQ ID NO: 1 with the N-terminus beginning at amino acid 230 of SEQ ID NO: 58 or a polypeptide that is at least 95% identical to SEQ ID NO: 58;
  b) R¹ comprises a N-terminal polypeptide fragment of SEQ ID NO: 1 with the C-terminus ending at amino acid 251 of SEQ ID NO: 58 or a polypeptide that is at least 95% identical to SEQ ID NO: 58, and R² comprises a C-terminal polypeptide fragment of SEQ ID NO: 1 with the N-terminus beginning at amino acid 252 of SEQ ID NO: 58 or a polypeptide that is at least 95% identical to SEQ ID NO: 58;

c) R¹ comprises a N-terminal polypeptide fragment of SEQ ID NO: 1 with the C-terminus ending at amino acid 256 of SEQ ID NO: 58 or a polypeptide that is at least 95% identical to SEQ ID NO: 58, and R² comprises a C-terminal polypeptide fragment of SEQ ID NO: 58 with the N-terminus beginning at amino acid 257 of SEQ ID NO: 58 or a polypeptide that is at least 95% identical to SEQ ID NO: 58; and d) R¹ comprises a N-terminal polypeptide fragment of SEQ ID NO: 1 with the C-terminus ending at amino acid 270 of SEQ ID NO: 58 or a polypeptide that is at least 95% identical to SEQ ID NO: 58, and R² comprises a C-terminal polypeptide fragment of SEQ ID NO: 1 with the N-terminus beginning at amino acid 271 of SEQ ID NO: 58 or a polypeptide that is at least 95% identical to SEQ ID NO: 58.

28. The system of paragraph 24, wherein the first (R¹) and second (R²) recombinase polypeptide fragments are Flp recombinase polypeptide fragments, wherein R¹ and R² are selected from the group consisting of:

a) R¹ comprises a N-terminal polypeptide fragment of SEQ ID NO: 60 with the C-terminus ending at amino acid 27 of SEQ ID NO: 60 or a polypeptide that is at least 95% identical to SEQ ID NO: 60, and R² comprises a C-terminal polypeptide fragment of SEQ ID NO: 60 with the N-terminus beginning at amino acid 28 of SEQ ID NO: 60 or a polypeptide that is at least 95% identical to SEQ ID NO: 60;

b) R¹ comprises a N-terminal polypeptide fragment of SEQ ID NO: 60 with the C-terminus ending at amino acid 168 of SEQ ID NO: 60 or a polypeptide that is at least 95% identical to SEQ ID NO: 60, and R² comprises a C-terminal polypeptide fragment of SEQ ID NO: 60 with the N-terminus beginning at amino acid 169 of SEQ ID NO: 60 or a polypeptide that is at least 95% identical to SEQ ID NO: 60;

c) R¹ comprises a N-terminal polypeptide fragment of SEQ ID NO: 60 with the C-terminus ending at amino acid 374 of SEQ ID NO: 60 or a polypeptide that is at least 95% identical to SEQ ID NO: 60, and R² comprises a C-terminal polypeptide fragment of SEQ ID NO: 60 with the N-terminus beginning at amino acid 375 of SEQ ID NO: 60 or a polypeptide that is at least 95% identical to SEQ ID NO: 60; and d) R¹ comprises a N-terminal polypeptide fragment of SEQ ID NO: 60 with the C-terminus ending at amino acid 396 of SEQ ID NO: 60 or a polypeptide that is at least 95% identical to SEQ ID NO: 60, and R² comprises a C-terminal polypeptide fragment of SEQ ID NO: 60 with the N-terminus beginning at amino acid 397 of SEQ ID NO: 60 or a polypeptide that is at least 95% identical to SEQ ID NO: 60.

29. The system of paragraph 24, wherein the first (R¹) and second (R²) recombinase polypeptide fragments are PhiC recombinase polypeptide fragments, wherein R¹ and R² are selected from the group consisting of:

a) R¹ comprises a N-terminal polypeptide fragment of SEQ ID NO: 62 with the C-terminus ending at amino acid 233 of SEQ ID NO: 62 or a polypeptide that is at least 95% identical to SEQ ID NO: 62, and R² comprises a C-terminal polypeptide fragment of SEQ ID NO: 62 with the N-terminus beginning at amino acid 234 of SEQ ID NO: 62 or a polypeptide that is at least 95% identical to SEQ ID NO: 62;

b) R¹ comprises a N-terminal polypeptide fragment of SEQ ID NO: 62 with the C-terminus ending at amino acid 396 of SEQ ID NO: 62 or a polypeptide that is at least 95% identical to SEQ ID NO: 62, and R² comprises a C-terminal polypeptide fragment of SEQ ID NO: 62 with the N-terminus beginning at amino acid 397 of SEQ ID NO: 62 or a polypeptide that is at least 95% identical to SEQ ID NO: 62;

c) R¹ comprises a N-terminal polypeptide fragment of SEQ ID NO: 62 with the C-terminus ending at amino acid 428 of SEQ ID NO: 62 or a polypeptide that is at least 95% identical to SEQ ID NO: 62, and R² comprises a C-terminal polypeptide fragment of SEQ ID NO: 62 with the N-terminus beginning at amino acid 429 of SEQ ID NO: 62 or a polypeptide that is at least 95% identical to SEQ ID NO: 62; and d) R¹ comprises a N-terminal polypeptide fragment of SEQ ID NO: 62 with the C-terminus ending at amino acid 571 of SEQ ID NO: 62 or a polypeptide that is at least 95% identical to SEQ ID NO: 62, and R² comprises a C-terminal polypeptide fragment of SEQ ID NO: 62 with the N-terminus beginning at amino acid 572 of SEQ ID NO: 62 or a polypeptide that is at least 95% identical to SEQ ID NO: 62.

30. The system of paragraph 24, wherein the first (R¹) and second (R²) recombinase polypeptide fragments are vCre recombinase polypeptide fragments, wherein R¹ and R² are selected from the group consisting of:

a) R¹ comprises a N-terminal polypeptide fragment of SEQ ID NO: 65 with the C-terminus ending at amino acid 82 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 83 of SEQ ID NO: 65 or a polypeptide that is at least 95% identical to SEQ ID NO: 65;

b) R¹ comprises a N-terminal polypeptide fragment of SEQ ID NO: 65 with the C-terminus ending at amino acid 172 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 173 of SEQ ID NO: 65 or a polypeptide that is at least 95% identical to SEQ ID NO: 65;

c) R¹ comprises a N-terminal polypeptide fragment of SEQ ID NO: 65 with the C-terminus ending at amino acid 210 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 211 of SEQ ID NO: 65 or a polypeptide that is at least 95% identical to SEQ ID NO: 65;

d) R¹ comprises a N-terminal polypeptide fragment of SEQ ID NO: 65 with the C-terminus ending at amino acid 269 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 270 of SEQ ID NO: 65 or a polypeptide that is at least 95% identical to SEQ ID NO: 65; and e) R¹ comprises a N-terminal polypeptide fragment of SEQ ID NO: 65 with the C-terminus ending at amino acid 277 of SEQ ID NO: 65 or a polypeptide that is at least 95% identical to SEQ ID NO: 65, and R² comprises a C-terminal polypeptide fragment of SEQ ID NO: 65 with the N-terminus beginning at amino acid 278 SEQ ID NO: 65 or a polypeptide that is at least 95% identical to SEQ ID NO: 65.

Some embodiments of the technology described herein can be defined according to any of the following numbered paragraphs:

1. An inducible split-nuclease polypeptide system comprising:
   a) a first polypeptide comprising:
      i) a first member of an inducible dimerization domain ($D^1$); and
      ii) a first polypeptide fragment of a sequence-specific nuclease ($N^1$); and
   b) a second polypeptide comprising:
      i) a second member of the inducible dimerization domain ($D^2$); and
      ii) a second polypeptide fragment of the sequence-specific nuclease ($N^2$); and wherein the first and second members of the inducible dimerization domain come together in the presence of an inducer agent or inducer signal, resulting in protein complementation of the two nuclease polypeptide fragments to form the active nuclease protein in the presence of the inducer agent or inducer signal.
2. An inducible split-recombinase polypeptide system comprising:
   a) a first polypeptide comprising:
      i) a first member of an inducible dimerization domain ($D^1$); and
      ii) a first polypeptide fragment of a recombinase ($R^1$); and
   b) a second polypeptide comprising:
      i) a second member of the inducible dimerization domain ($D^2$); and
      ii) a second polypeptide fragment of the recombinase ($R^2$); and
   wherein the first and second members of the inducible dimerization domain come together in the presence of an inducer agent or inducer signal, resulting in protein complementation of the two recombinase polypeptide fragments to form the active recombinase protein in the presence of the inducer agent or inducer signal.
3. The system of paragraph 1 or 2, wherein the first ($D^1$) and second ($D^2$) members of the inducible dimerization domain comprise a caffeine-induced dimerization system.
4. The system of any one of paragraphs 1-3, wherein $D^1$ and $D^2$ each comprise a VHH camelid antibody that specifically binds to caffeine (CaffVHH).
5. The system of any one of paragraphs 1-4, wherein $D^1$ and $D^2$ each comprise a tandem VHH camelid antibody that specifically binds to caffeine (tandem CaffVHH).
6. The system of paragraph 4 or 5, wherein one of $D^1$ or $D^2$ is encoded by a nucleic acid that is codon-optimized to prevent recombination.
7. The system of paragraph 1 or 2, wherein $D^1$ and $D^2$ are selected from the group consisting of:
   a) $D^1$ comprising a GID1 domain or a fragment thereof, and $D^2$ comprising a GAI domain, wherein the GID1 domain and GAI domain bind to the inducer agent Gibberellin Ester (GIB);
   b) $D^2$ comprising a GID1 domain or a fragment thereof, and $D^1$ comprising a GAI domain, wherein the GID1 domain and GAI domain bind to the inducer agent Gibberellin Ester (GIB);
   c) $D^1$ comprising a FKBP domain or a fragment thereof, and $D^2$ comprising a FRB domain, wherein the FKBP domain and FRB domain bind to the inducer agent Rapalog (RAP);
   d) $D^2$ comprising a FKBP domain or a fragment thereof, and $D^1$ comprising a FRB domain, wherein the FKBP domain and FRB domain bind to the inducer agent Rapalog (RAP);
   e) $D^1$ comprising a PYL domain or a fragment thereof, and $D^2$ comprising an ABI domain, wherein the PYL domain and ABI domain bind to the inducer agent Abscisic acid (ABA);
   f) $D^2$ comprising a PYL domain or a fragment thereof, and $D^1$ comprising an ABI domain, wherein the PYL domain and ABI domain bind to the inducer agent Abscisic acid (ABA);
   g) $D^1$ comprising a Light-inducible dimerization domain (LIDD), wherein a LIDD dimerizes with a complementary LIDD ($D^2$) upon exposure to a light inducer signal of an appropriate wavelength; and
   h) $D^2$ comprising a Light-inducible dimerization domain (LIDD), wherein a LIDD dimerizes with a complementary LIDD ($D^1$) upon exposure to a light inducer signal of an appropriate wavelength.
8. The system of paragraph 7, wherein the LIDD is nMag or CIBN or a photochromic protein domain, wherein nMag can dimerize with the complementary LIDD pMag upon exposure to a blue light inducer signal, and wherein CIBN can dimerize with the complementary CRY2 upon exposure to a blue inducer light signal, and wherein the photochromic proteins can dimerize upon exposure to a blue inducer light signal.
9. The system of paragraph 7 or 8, wherein the light inducer signal is a pulse light signal.
10. The system of paragraph 1 or 2, wherein:
    a) $D^1$ comprises a repressible protease and $D^2$ comprises a reader domain; or
    b) $D^2$ comprises a repressible protease and $D^1$ comprises a reader domain;
    wherein the reader domain specifically binds to a repressible protease in the presence of a specific protease inhibitor.
11. The system of paragraph 10, wherein the repressible protease is hepatitis C virus (HCV) nonstructural protein 3 (NS3).
12. The system of any one of paragraphs 10-11, wherein the NS3 is catalytically dead.
13. The system of any one of paragraphs 10-12, wherein the first or second polypeptide does not comprise any protease cleavage sites.
14. The system of any one of paragraphs 10-13, further comprising a cofactor for the repressible protease.
15. The system of paragraph 14, wherein the cofactor is an HSV NS4A domain.
16. The system of paragraph 15, wherein the HSV NS4A domain is adjacent and N-terminal to the repressible protease.
17. The system of paragraph 10, wherein the reader domain is selected from the group consisting of:
    a) a danoprevir/NS3 complex reader (DNCR) domain; and
    b) a grazoprevir/NS3 reader complex (GNCR) domain.
18. The system of paragraph 10, wherein the protease inhibitor is selected from grazoprevir, danoprevir, simeprevir, asunaprevir, ciluprevir, boceprevir, sovaprevir, paritaprevir, ombitasvir, paritaprevir, ritonavir, dasabuvir, and telaprevir.

19. The system of paragraph 10, wherein the reader domain is DNCR and the protease inhibitor is danoprevir.
20. The system of paragraph 10, wherein the reader domain is GNCR and the protease inhibitor is grazoprevir.
21. A repressible split-nuclease polypeptide system comprising:
   a) a first polypeptide comprising:
      i) a first member of a repressible dimerization domain ($RD^1$); and
      ii) a first polypeptide fragment of a sequence-specific nuclease ($N^1$); and
   b) a second polypeptide comprising:
      i) a second member of the repressible dimerization domain ($RD^2$); and
      ii) a second polypeptide fragment of the sequence-specific nuclease ($N^2$); and
   wherein the first and second members of the repressible dimerization domain come together in the absence of a repressor agent or target signal, resulting in protein complementation of the two nuclease polypeptide fragments to form the active nuclease protein in the absence of the repressor agent or repressor signal;
   wherein the first and second members of the repressible dimerization domain do not come together in the presence of the repressor agent or repressor signal, resulting in no protein complementation of the two nuclease polypeptide fragments and no formation of the active nuclease protein in the presence of the repressor agent or repressor signal.
22. A repressible split-recombinase polypeptide system comprising:
   a) a first polypeptide comprising:
      i) a first member of a repressible dimerization domain ($RD^1$); and
      ii) a first polypeptide fragment of a recombinase ($R^1$); and
   b) a second polypeptide comprising:
      i) a second member of the repressible dimerization domain ($RD^2$); and
      ii) a second polypeptide fragment of the recombinase ($R^2$); and
   wherein the first and second members of the repressible dimerization domain come together in the absence of a repressor agent or repressor signal, resulting in protein complementation of the two recombinase polypeptide fragments to form the active recombinase protein in the absence of the repressor agent or repressor signal;
   wherein the first and second members of the repressible dimerization domain do not come together in the presence of the repressor agent or repressor signal, resulting in no protein complementation of the two recombinase polypeptide fragments and no formation of the active recombinase protein in the presence of the repressor agent or repressor signal.
23. The system of paragraph 21 or 22, wherein:
   a) $RD^1$ comprises a repressible protease and $RD^2$ comprises a peptide domain; or
   b) $RD^2$ comprises a repressible protease and $RD^1$ comprises a peptide domain;
   wherein the repressible protease specifically binds to the peptide domain in the absence of a specific protease inhibitor.
24. The system of any one of paragraphs 21-23, wherein the repressible protease does not specifically bind to the peptide domain in the presence of a specific protease inhibitor.
25. The system of any one of paragraphs 21-24, wherein the repressible protease is hepatitis C virus (HCV) nonstructural protein 3 (NS3).
26. The system of paragraph 25, wherein the NS3 is catalytically dead.
27. The system of any one of paragraphs 21-26, wherein the polypeptide does not comprise any protease cleavage sites.
28. The system of any one of paragraphs 21-27, further comprising a cofactor for the repressible protease.
29. The system of paragraph 28, wherein the cofactor is an HSV NS4A domain.
30. The system of paragraph 29, wherein the HSV NS4A domain is adjacent and N-terminal to the repressible protease.
31. The system of any one of paragraphs 21-30, wherein the peptide domain comprises ANR peptide SEQ ID NO: 170) or CP5-46-5D5E peptide (SEQ ID NO: 171).
32. The system of any one of paragraphs 21-31, wherein the protease inhibitor is selected from grazoprevir, danoprevir, simeprevir, asunaprevir, ciluprevir, boceprevir, sovaprevir, paritaprevir, ombitasvir, paritaprevir, ritonavir, dasabuvir, and telaprevir.
33. The system of any one of paragraphs 21-31, wherein the protease inhibitor is danoprevir or grazoprevir.
34. An inducible nuclease split-recombinase polypeptide system comprising:
   a) a first polypeptide comprising:
      i) a first sequence-specific nuclease ($N^A$); and
      ii) a first polypeptide fragment of a recombinase ($R^1$); and
   b) a second polypeptide comprising:
      i) a second sequence-specific nuclease ($N^B$); and
      ii) a second polypeptide fragment of the recombinase ($R^2$); and
   wherein the first and second sequence-specific nucleases each specifically bind to first and second target nucleic acids in the presence of first and second guide nucleic acids, wherein the first and second target nucleic acids are in close proximity to each other, resulting in protein complementation of the two recombinase polypeptide fragments to form the active recombinase protein in the presence of the guide nucleic acids and first and second target nucleic acids.
35. The system of paragraph 34, wherein $N^A$ and $N^B$ are comprised by different sequence-specific nucleases that each recognize their guide nucleic acid orthogonally.
36. The system of paragraph 34 or 35, wherein the first and second target nucleic acids are comprised by the same nucleic acid molecule.
37. The system of any one of paragraphs 34-36, wherein the first and second target nucleic acids are within 300 nucleotides of each other.
38. An inducible split-nuclease split-recombinase polypeptide system comprising:
   a) a first polypeptide comprising:
      i) a first polypeptide fragment of a sequence-specific nuclease ($N^1$); and
      ii) a first polypeptide fragment of a recombinase ($R^1$); and b) a second polypeptide comprising:
  i) a second polypeptide fragment of the sequence-specific nuclease ($N^2$); and
  ii) a second polypeptide fragment of the recombinase ($R^2$); and
wherein the first and second polypeptide fragments of the sequence specific nuclease come together in the presence of a guide nucleic acid and a nucleic acid targeted by the guide nucleic acid, resulting in protein complementation of the two recombinase polypeptide fragments to form the active recombinase protein in the presence of the guide nucleic acid and a target nucleic acid targeted by the guide nucleic acid.

39. An inducible split-nuclease sequestering polypeptide system comprising:
  a) a first polypeptide comprising a first polypeptide fragment of a sequence-specific nuclease ($N^1$); and
  b) a second polypeptide comprising a second polypeptide fragment of the sequence-specific nuclease ($N^2$); and
  wherein the first and/or second polypeptide comprises a cytosolic sequestering domain comprising a ligand binding domain (LBD), wherein, in the presence of a ligand, the sequestering of the protein to the cytosol is inhibited; wherein the first and/or second polypeptides are transported to the nucleus in the presence of the ligand, resulting in protein complementation of the two nuclease polypeptide fragments to form the active nuclease protein in the presence of the ligand.

40. An inducible split-recombinase sequestering polypeptide system comprising:
  a) a first polypeptide comprising a first polypeptide fragment of a recombinase ($R^1$); and
  b) a second polypeptide comprising a second polypeptide fragment of the recombinase ($R^2$); and wherein the first and/or second polypeptide comprises a cytosolic sequestering domain comprising a ligand binding domain (LBD), wherein, in the presence of a ligand, the sequestering of the protein to the cytosol is inhibited; wherein the first and/or second polypeptides are transported to the nucleus in the presence of the ligand, resulting in protein complementation of the two recombinase polypeptide fragments to form the active recombinase protein in the presence of the ligand.

41. An inducible nuclear split-nuclease polypeptide system comprising:
  a) a first polypeptide comprising:
    i) a first polypeptide fragment of a sequence-specific nuclease ($N^1$); and
    ii) a nuclear localization signal (NLS); and
  b) a second polypeptide comprising:
    i) a second polypeptide fragment of the sequence-specific nuclease ($N^2$); and
    ii) a nuclear localization signal (NLS);
  wherein the first and second polypeptides come together in the nucleus in the presence of a guide nucleic acid, resulting in protein complementation of the two nuclease polypeptide fragments to form the active nuclease protein in the presence of the guide nucleic acid.

42. An inducible cytoplasmic split-nuclease polypeptide system comprising:
  a) a first polypeptide comprising:
    i) a first polypeptide fragment of a sequence-specific nuclease ($N^1$); and
    ii) a nuclear export signal (NES); and
  b) a second polypeptide comprising:
    i) a second polypeptide fragment of the sequence-specific nuclease ($N^2$); and
    ii) a nuclear export signal (NES);
  wherein the first and second polypeptides come together in the cytoplasm in the presence of a guide nucleic acid, resulting in protein complementation of the two nuclease polypeptide fragments to form the active nuclease protein in the presence of the guide nucleic acid.

43. The system of any one of paragraphs 1-42, wherein the sequence-specific nuclease is a Cas endonuclease.

44. The system of paragraph 43, wherein the Cas endonuclease is Cas13 endonuclease.

45. The system of paragraph 43 or 44, wherein the Cas13 endonuclease is Cas13a, Cas13b, or Cas13d.

46. The system of any one of paragraphs 43-45, wherein the Cas endonuclease is in combination with a guide nucleic acid that specifically binds to a target nucleic acid.

47. The system of any one of paragraphs 43-46, wherein the Cas endonuclease exhibits collateral cleavage of non-guide nucleic acids.

48. The system of any one of paragraphs 43-47, wherein the Cas endonuclease can process pre-guide nucleic arrays to produce multiple guide nucleic acids each targeting a different target nucleic acid.

49. The system of any one of paragraphs 43-48, wherein the target nucleic acid is a circular nucleic acid.

50. The system of any one of paragraphs 43-49, wherein the Cas endonuclease is Cas13d.

51. The system of any one of paragraphs 43-50, wherein the Cas endonuclease is RfxCas13d.

52. The system of paragraph 50 or 51, wherein the Cas13d comprises the sequence of SEQ ID NO: 1 or a sequence that is at least 85% identical to SEQ ID NO: 1 that maintains the same function.

53. The system of any one of paragraphs 1, 21, 38, 39, 41, or 42 wherein the first ($N^1$) and second ($N^2$) nuclease polypeptide fragments are Cas13d endonuclease polypeptide fragments, wherein $N^1$ and $N^2$ are selected from the group consisting of:
  a) $N^1$ comprises a N-terminal polypeptide fragment of SEQ ID NO: 1 with the C-terminus ending at amino acid 88 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 89 of SEQ ID NO: 1 or a polypeptide that is at least 85% identical to SEQ ID NO: 1;
  b) $N^1$ comprises a N-terminal polypeptide fragment of SEQ ID NO: 1 with the C-terminus ending at amino acid 263 of SEQ ID NO: 1 or a polypeptide that is at least 85% identical to SEQ ID NO: 1, and $N^2$ comprises a C-terminal polypeptide fragment of SEQ ID NO: 1 with the N-terminus beginning at amino acid 264 of SEQ ID NO: 1 or a polypeptide that is at least 85% identical to SEQ ID NO: 1;
  c) $N^1$ comprises a N-terminal polypeptide fragment of SEQ ID NO: 1 with the C-terminus ending at amino acid 384 of SEQ ID NO: 1 or a polypeptide that is at least 85% identical to SEQ ID NO: 1, and N² comprises a C-terminal polypeptide fragment of SEQ ID NO: 1 with the N-terminus beginning at amino acid 385 of SEQ ID NO: 1 or a polypeptide that is at least 85% identical to SEQ ID NO: 1;

d) N¹ comprises a N-terminal polypeptide fragment of SEQ ID NO: 1 with the C-terminus ending at amino acid 404 of SEQ ID NO: 1 or a polypeptide that is at least 85% identical to SEQ ID NO: 1, and N² comprises a C-terminal polypeptide fragment of SEQ ID NO: 1 with the N-terminus beginning at amino acid 405 of SEQ ID NO: 1 or a polypeptide that is at least 85% identical to SEQ ID NO: 1;

e) N¹ comprises a N-terminal polypeptide fragment of SEQ ID NO: 1 with the C-terminus ending at amino acid 507 of SEQ ID NO: 1 or a polypeptide that is at least 85% identical to SEQ ID NO: 1, and N² comprises a C-terminal polypeptide fragment of SEQ ID NO: 1 with the N-terminus beginning at amino acid 508 of SEQ ID NO: 1 or a polypeptide that is at least 85% identical to SEQ ID NO: 1;

f) N¹ comprises a N-terminal polypeptide fragment of SEQ ID NO: 1 with the C-terminus ending at amino acid 559 of SEQ ID NO: 1 or a polypeptide that is at least 85% identical to SEQ ID NO: 1, and N² comprises a C-terminal polypeptide fragment of SEQ ID NO: 1 with the N-terminus beginning at amino acid 560 of SEQ ID NO: 1 or a polypeptide that is at least 85% identical to SEQ ID NO: 1;

g) N¹ comprises a N-terminal polypeptide fragment of SEQ ID NO: 1 with the C-terminus ending at amino acid 565 of SEQ ID NO: 1 or a polypeptide that is at least 85% identical to SEQ ID NO: 1, and N² comprises a C-terminal polypeptide fragment of SEQ ID NO: 1 with the N-terminus beginning at amino acid 566 of SEQ ID NO: 1 or a polypeptide that is at least 85% identical to SEQ ID NO: 1;

h) N¹ comprises a N-terminal polypeptide fragment of SEQ ID NO: 1 with the C-terminus ending at amino acid 576 of SEQ ID NO: 1 or a polypeptide that is at least 85% identical to SEQ ID NO: 1, and N² comprises a C-terminal polypeptide fragment of SEQ ID NO: 1 with the N-terminus beginning at amino acid 577 of SEQ ID NO: 1 or a polypeptide that is at least 85% identical to SEQ ID NO: 1;

i) N¹ comprises a N-terminal polypeptide fragment of SEQ ID NO: 1 with the C-terminus ending at amino acid 655 of SEQ ID NO: 1 or a polypeptide that is at least 85% identical to SEQ ID NO: 1, and N² comprises a C-terminal polypeptide fragment of SEQ ID NO: 1 with the N-terminus beginning at amino acid 656 of SEQ ID NO: 1 or a polypeptide that is at least 85% identical to SEQ ID NO: 1; and j) N¹ comprises a N-terminal polypeptide fragment of SEQ ID NO: 1 with the C-terminus ending at amino acid 903 of SEQ ID NO: 1 or a polypeptide that is at least 85% identical to SEQ ID NO: 1, and N² comprises a C-terminal polypeptide fragment of SEQ ID NO: 1 with the N-terminus beginning at amino acid 904 of SEQ ID NO: 1 or a polypeptide that is at least 85% identical to SEQ ID NO: 1.

54. The system of any one of paragraphs 43-49, wherein the Cas endonuclease is Cas13a.

55. The system of paragraph 54, wherein the Cas13a comprises the sequence of SEQ ID NO: 2 or a sequence that is at least 85% identical to SEQ ID NO: 2 that maintains the same function.

56. The system of any one of paragraphs 1, 21, 38, 39, 41, or 42, wherein the first (N¹) and second (N²) nuclease polypeptide fragments are Cas13a endonuclease polypeptide fragments, wherein N¹ and N² are selected from the group consisting of:

a) N¹ comprises a N-terminal polypeptide fragment of SEQ ID NO: 2 with the C-terminus ending at amino acid 416 of SEQ ID NO: 2 or a polypeptide that is at least 85% identical to SEQ ID NO: 2, and N² comprises a C-terminal polypeptide fragment of SEQ ID NO: 2 with the N-terminus beginning at amino acid 417 of SEQ ID NO: 2 or a polypeptide that is at least 85% identical to SEQ ID NO: 2; and b) N¹ comprises a N-terminal polypeptide fragment of SEQ ID NO: 2 with the C-terminus ending at amino acid 421 of SEQ ID NO: 2 or a polypeptide that is at least 85% identical to SEQ ID NO: 2, and N² comprises a C-terminal polypeptide fragment of SEQ ID NO: 2 with the N-terminus beginning at amino acid 422 of SEQ ID NO: 2 or a polypeptide that is at least 85% identical to SEQ ID NO: 2.

57. The system of any one of paragraphs 43-49, wherein the Cas endonuclease is Cas13b.

58. The system of paragraph 57, wherein the Cas13b comprises the sequence of SEQ ID NO: 3 or a sequence that is at least 85% identical to SEQ ID NO: 3 that maintains the same function.

59. The system of any one of paragraphs 1, 21, 38, 39, 41, or 42, wherein the first (N¹) and second (N²) nuclease polypeptide fragments are Cas13b endonuclease polypeptide fragments, wherein N¹ and N² are selected from the group consisting of:

a) N¹ comprises a N-terminal polypeptide fragment of SEQ ID NO: 3 with the C-terminus ending at amino acid 49 of SEQ ID NO: 3 or a polypeptide that is at least 85% identical to SEQ ID NO: 3, and N² comprises a C-terminal polypeptide fragment of SEQ ID NO: 3 with the N-terminus beginning at amino acid 50 of SEQ ID NO: 3 or a polypeptide that is at least 85% identical to SEQ ID NO: 3;

b) N¹ comprises a N-terminal polypeptide fragment of SEQ ID NO: 3 with the C-terminus ending at amino acid 177 of SEQ ID NO: 3 or a polypeptide that is at least 85% identical to SEQ ID NO: 3, and N² comprises a C-terminal polypeptide fragment of SEQ ID NO: 3 with the N-terminus beginning at amino acid 178 of SEQ ID NO: 3 or a polypeptide that is at least 85% identical to SEQ ID NO: 3;

c) N¹ comprises a N-terminal polypeptide fragment of SEQ ID NO: 3 with the C-terminus ending at amino acid 250 of SEQ ID NO: 3 or a polypeptide that is at least 85% identical to SEQ ID NO: 3, and N² comprises a C-terminal polypeptide fragment of SEQ ID NO: 3 with the N-terminus beginning at amino acid 251 of SEQ ID NO: 3 or a polypeptide that is at least 85% identical to SEQ ID NO: 3;

d) N¹ comprises a N-terminal polypeptide fragment of SEQ ID NO: 3 with the C-terminus ending at amino acid 431 of SEQ ID NO: 3 or a polypeptide that is at least 85% identical to SEQ ID NO: 3, and N² comprises a C-terminal polypeptide fragment of SEQ ID NO: 3 with the N-terminus beginning at amino acid 432 of SEQ ID NO: 3 or a polypeptide that is at least 85% identical to SEQ ID NO: 3; and e) N¹ comprises a N-terminal polypeptide fragment of SEQ ID NO: 3 with the C-terminus ending at amino acid 1065 of SEQ ID NO: 3 or a polypeptide that is at least 85% identical to SEQ ID NO: 3, and N² comprises a C-terminal polypeptide fragment of SEQ ID NO: 3 with the N-terminus beginning at amino acid 1066 of SEQ ID NO: 3 or a polypeptide that is at least 85% identical to SEQ ID NO: 3.

60. The system of any one of paragraphs 1-59, wherein the recombinase is selected from the group consisting of Cre, Flp, PhiC, and vCre recombinases.

61. The system of paragraph 60, wherein the recombinase is a Cre recombinase.

62. The system of paragraph 60 or 61, wherein the Cre recombinase comprises the sequence of SEQ ID NO: 58 or a sequence that is at least 85% identical to SEQ ID NO: 58 that maintains the same function.

63. The system of any one of paragraphs 2, 22, 34, 38, or 40, wherein the first ($R^1$) and second ($R^2$) recombinase polypeptide fragments are Cre recombinase polypeptide fragments, wherein $R^1$ and $R^2$ are selected from the group consisting of:
   a) $R^1$ comprises a N-terminal polypeptide fragment of SEQ ID NO: 1 with the C-terminus ending at amino acid 229 of SEQ ID NO: 58 or a polypeptide that is at least 85% identical to SEQ ID NO: 58, and $R^2$ comprises a C-terminal polypeptide fragment of SEQ ID NO: 1 with the N-terminus beginning at amino acid 230 of SEQ ID NO: 58 or a polypeptide that is at least 85% identical to SEQ ID NO: 58;
   b) $R^1$ comprises a N-terminal polypeptide fragment of SEQ ID NO: 1 with the C-terminus ending at amino acid 251 of SEQ ID NO: 58 or a polypeptide that is at least 85% identical to SEQ ID NO: 58, and $R^2$ comprises a C-terminal polypeptide fragment of SEQ ID NO: 1 with the N-terminus beginning at amino acid 252 of SEQ ID NO: 58 or a polypeptide that is at least 85% identical to SEQ ID NO: 58;
   c) $R^1$ comprises a N-terminal polypeptide fragment of SEQ ID NO: 1 with the C-terminus ending at amino acid 256 of SEQ ID NO: 58 or a polypeptide that is at least 85% identical to SEQ ID NO: 58, and $R^2$ comprises a C-terminal polypeptide fragment of SEQ ID NO: 58 with the N-terminus beginning at amino acid 257 of SEQ ID NO: 58 or a polypeptide that is at least 85% identical to SEQ ID NO: 58; and
   d) $R^1$ comprises a N-terminal polypeptide fragment of SEQ ID NO: 1 with the C-terminus ending at amino acid 270 of SEQ ID NO: 58 or a polypeptide that is at least 85% identical to SEQ ID NO: 58, and $R^2$ comprises a C-terminal polypeptide fragment of SEQ ID NO: 1 with the N-terminus beginning at amino acid 271 of SEQ ID NO: 58 or a polypeptide that is at least 85% identical to SEQ ID NO: 58.

64. The system of any one of paragraphs 1-59, wherein the recombinase is a Flp recombinase.

65. The system of paragraph 64, wherein the Flp recombinase comprises the sequence of SEQ ID NO: 60 or a sequence that is at least 85% identical to SEQ ID NO: 60 that maintains the same function.

66. The system of any one of paragraphs 2, 22, 34, 38, or 40, wherein the first ($R^1$) and second ($R^2$) recombinase polypeptide fragments are Flp recombinase polypeptide fragments, wherein $R^1$ and $R^2$ are selected from the group consisting of:
   a) $R^1$ comprises a N-terminal polypeptide fragment of SEQ ID NO: 60 with the C-terminus ending at amino acid 27 of SEQ ID NO: 60 or a polypeptide that is at least 85% identical to SEQ ID NO: 60, and $R^2$ comprises a C-terminal polypeptide fragment of SEQ ID NO: 60 with the N-terminus beginning at amino acid 28 of SEQ ID NO: 60 or a polypeptide that is at least 85% identical to SEQ ID NO: 60;
   b) $R^1$ comprises a N-terminal polypeptide fragment of SEQ ID NO: 60 with the C-terminus ending at amino acid 168 of SEQ ID NO: 60 or a polypeptide that is at least 85% identical to SEQ ID NO: 60, and $R^2$ comprises a C-terminal polypeptide fragment of SEQ ID NO: 60 with the N-terminus beginning at amino acid 169 of SEQ ID NO: 60 or a polypeptide that is at least 85% identical to SEQ ID NO: 60;
   c) $R^1$ comprises a N-terminal polypeptide fragment of SEQ ID NO: 60 with the C-terminus ending at amino acid 374 of SEQ ID NO: 60 or a polypeptide that is at least 85% identical to SEQ ID NO: 60, and $R^2$ comprises a C-terminal polypeptide fragment of SEQ ID NO: 60 with the N-terminus beginning at amino acid 375 of SEQ ID NO: 60 or a polypeptide that is at least 85% identical to SEQ ID NO: 60; and
   d) $R^1$ comprises a N-terminal polypeptide fragment of SEQ ID NO: 60 with the C-terminus ending at amino acid 396 of SEQ ID NO: 60 or a polypeptide that is at least 85% identical to SEQ ID NO: 60, and $R^2$ comprises a C-terminal polypeptide fragment of SEQ ID NO: 60 with the N-terminus beginning at amino acid 397 of SEQ ID NO: 60 or a polypeptide that is at least 85% identical to SEQ ID NO: 60.

67. The system of any one of paragraphs 1-59, wherein the recombinase is a PhiC recombinase.

68. The system of paragraph 67, wherein the PhiC recombinase comprises the sequence of SEQ ID NO: 62 or a sequence that is at least 85% identical to SEQ ID NO: 62 that maintains the same function.

69. The system of any one of paragraphs 2, 22, 34, 38, or 40, wherein the first ($R^1$) and second ($R^2$) recombinase polypeptide fragments are PhiC recombinase polypeptide fragments, wherein $R^1$ and $R^2$ are selected from the group consisting of:
   a) $R^1$ comprises a N-terminal polypeptide fragment of SEQ ID NO: 62 with the C-terminus ending at amino acid 233 of SEQ ID NO: 62 or a polypeptide that is at least 85% identical to SEQ ID NO: 62, and $R^2$ comprises a C-terminal polypeptide fragment of SEQ ID NO: 62 with the N-terminus beginning at amino acid 234 of SEQ ID NO: 62 or a polypeptide that is at least 85% identical to SEQ ID NO: 62;
   b) $R^1$ comprises a N-terminal polypeptide fragment of SEQ ID NO: 62 with the C-terminus ending at amino acid 396 of SEQ ID NO: 62 or a polypeptide that is at least 85% identical to SEQ ID NO: 62, and $R^2$ comprises a C-terminal polypeptide fragment of SEQ ID NO: 62 with the N-terminus beginning at amino acid 397 of SEQ ID NO: 62 or a polypeptide that is at least 85% identical to SEQ ID NO: 62;
   c) $R^1$ comprises a N-terminal polypeptide fragment of SEQ ID NO: 62 with the C-terminus ending at amino acid 428 of SEQ ID NO: 62 or a polypeptide that is at least 85% identical to SEQ ID NO: 62, and $R^2$ comprises a C-terminal polypeptide fragment of SEQ ID NO: 62 with the N-terminus beginning at amino acid 429 of SEQ ID NO: 62 or a polypeptide that is at least 85% identical to SEQ ID NO: 62; and
   d) $R^1$ comprises a N-terminal polypeptide fragment of SEQ ID NO: 62 with the C-terminus ending at amino acid 571 of SEQ ID NO: 62 or a polypeptide that is at least 85% identical to SEQ ID NO: 62, and $R^2$ comprises a C-terminal polypeptide fragment of SEQ ID NO: 62 with the N-terminus beginning at amino acid 572 of SEQ ID NO: 62 or a polypeptide that is at least 85% identical to SEQ ID NO: 62.
70. The system of any one of paragraphs 1-59, wherein the recombinase is a vCre recombinase.
71. The system of paragraph 70, wherein the vCre recombinase comprises the sequence of SEQ ID NO: 65 or a sequence that is at least 85% identical to SEQ ID NO: 65 that maintains the same function.
72. The system of any one of paragraphs 2, 22, 34, 38, or 40, wherein the first ($R^1$) and second ($R^2$) recombinase polypeptide fragments are vCre recombinase polypeptide fragments, wherein $R^1$ and $R^2$ are selected from the group consisting of:
  a) $R^1$ comprises a N-terminal polypeptide fragment of SEQ ID NO: 65 with the C-terminus ending at amino acid 82 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 83 of SEQ ID NO: 65 or a polypeptide that is at least 85% identical to SEQ ID NO: 65;
  b) $R^1$ comprises a N-terminal polypeptide fragment of SEQ ID NO: 65 with the C-terminus ending at amino acid 172 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 173 of SEQ ID NO: 65 or a polypeptide that is at least 85% identical to SEQ ID NO: 65;
  c) $R^1$ comprises a N-terminal polypeptide fragment of SEQ ID NO: 65 with the C-terminus ending at amino acid 210 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 211 of SEQ ID NO: 65 or a polypeptide that is at least 85% identical to SEQ ID NO: 65;
  d) $R^1$ comprises a N-terminal polypeptide fragment of SEQ ID NO: 65 with the C-terminus ending at amino acid 269 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 270 of SEQ ID NO: 65 or a polypeptide that is at least 85% identical to SEQ ID NO: 65; and
  e) $R^1$ comprises a N-terminal polypeptide fragment of SEQ ID NO: 65 with the C-terminus ending at amino acid 277 of SEQ ID NO: 65 or a polypeptide that is at least 85% identical to SEQ ID NO: 65, and $R^2$ comprises a C-terminal polypeptide fragment of SEQ ID NO: 65 with the N-terminus beginning at amino acid 278 SEQ ID NO: 65 or a polypeptide that is at least 85% identical to SEQ ID NO: 65.
73. The system of any one of paragraphs 1-72, wherein the first and/or second polypeptide further comprises at least one cytosolic sequestering domain.
74. The system of any one of paragraphs 39, 40, or 73, wherein the cytosolic sequestering domain comprises a ligand binding domain (LBD), wherein, in the presence of a ligand, the sequestering of the protein to the cytosol is inhibited.
75. The system of any one of paragraphs 39, 40, 73, or 74, wherein the cytosolic sequestering domain comprises a ligand binding domain (LBD) and a nuclear localization signal (NLS), wherein, in the absence of the ligand, the NLS is inhibited thereby preventing translocation of the sequestering protein to the nucleus, and wherein, in the presence of the ligand, the nuclear localization signal is exposed permitting translocation of the polypeptide to the nucleus.
76. The system of any one of paragraphs 1-75, wherein the first and/or second polypeptide further comprises at least a portion of the estrogen receptor (ER).
77. The system of any one of paragraphs 39, 40, 73-76, wherein the cytosolic sequestering domain comprises an estrogen ligand binding domain (ERT) or a variant thereof, selected from the group consisting of: ERT2, ERT, and ERT3.
78. The system of any paragraph 78, wherein the ERT binds to one or more ligands selected from: tamoxifen, 4-hydroxytamoxifen (4OHT), endoxifen, Fulvestrant, wherein binding of the ligand to ERT exposes the NLS and results in nuclear translocation of the ERT.
79. The system of any one of paragraphs 39, 40, 73-76, wherein the cytosolic sequestering domain comprises a transmembrane sequestering domain.
80. The system of paragraph 79, wherein the transmembrane sequestering domain comprises SynNotch.
81. The system of any one of paragraphs 1-80, wherein the first polypeptide or second polypeptide further comprises at least one nuclear export signal (NES).
82. The system of any one of paragraphs 1-81, wherein the first polypeptide or second polypeptide further comprises at least two nuclear export signals (NES).
83. The system of any one of paragraphs 42, 81, or 82, wherein the NES comprises HIV-1 Rev NES (LPPLERLTL, SEQ ID NO: 192) or focal adhesion kinase NES (LDLASLIL, SEQ ID NO: 2168).
84. The system of any one of paragraphs 1-83, wherein the first polypeptide or second polypeptide further comprises at least one nuclear localization signal (NLS).
85. The system of any one of paragraphs 1-84, wherein the first polypeptide or second polypeptide further comprises at least two nuclear localization signals (NLS).
86. The system of any one of paragraphs 41, 84, or 85, wherein the NLS comprises simian virus 40 (SV40) NLS (PKKKRKV, SEQ ID NO: 193) or nucleoplasmin (NPM2) NLS (KRVAPQKQMSIAKKKKV, SEQ ID NO: 194).
87. The system of any one of paragraphs 1-86, wherein the first polypeptide and second polypeptide are physically linked to one another.
88. The system of any one of paragraphs 1-87, wherein the first polypeptide and second polypeptide flank a self-cleaving peptide domain.
89. A polynucleotide encoding the first polypeptide, second polypeptide, or system of any one of paragraphs 1-88.
90. The polynucleotide of paragraph 89, wherein the first polypeptide, second polypeptide, or system is operatively linked to a promoter.
91. The polynucleotide of paragraph 90, wherein the promoter is a constitutive promoter.
92. The polynucleotide of paragraph 91, wherein the constitutive promoter is a CAG promoter.
93. The polynucleotide of paragraph 90, wherein the promoter is an inducible promoter.

94. A polynucleotide system comprising:
   a) a first polynucleotide encoding for the first polypeptide of any one of paragraphs 1-88; and
   b) a second polynucleotide encoding for the second polypeptide of any one of paragraphs 1-88; wherein the first and/or second polynucleotide is operatively linked to an inducible promoter.
95. The polynucleotide of paragraph 93 or 94, wherein the inducible promoter is induced by PMA, TGFβ, TNFa, or WNT.
96. The polynucleotide of any one of paragraphs 93-95, wherein the inducible promoter is selected from the group consisting of pAP1, pNFkB, pCAGA12, and pSTF.
97. The polynucleotide of paragraph 93 or 94, wherein the inducible promoter is a doxycycline inducible promoter.
98. A vector comprising the polynucleotide of any one of paragraphs 89-97.
99. The vector of paragraph 98, wherein the vector is a viral vector.
100. A cell or population thereof comprising the polypeptide or system of any one of paragraphs 1-88, the polynucleotide of any one of paragraphs 89-97, or the vector of any one of paragraphs 98-99.
101. The cell of paragraph 100, wherein the cell comprises an immune cell.
102. The cell of paragraph 101, wherein the immune cell comprises a CD4+ T cell, a CD8+ T cell, a regulatory T cell (Treg), or a natural killer (NK) cell.
103. A pharmaceutical composition comprising the polypeptide or system of any one of paragraphs 1-88, the polynucleotide of any one of paragraphs 89-97, the vector of any one of paragraphs 98-99, or the cell of any one of paragraphs 100-102, and a pharmaceutically acceptable carrier.
104. A kit comprising the polypeptide or system of any one of paragraphs 1-88, the polynucleotide of any one of paragraphs 89-97, the vector of any one of paragraphs 98-99, the cell of any one of paragraphs 100-102, or the pharmaceutical composition of paragraph 103.
105. The polypeptide or system of any one of paragraphs 1-88, the polynucleotide of any one of paragraphs 89-97, the vector of any one of paragraphs 98-99, the cell of any one of paragraphs 100-102, the pharmaceutical composition of paragraph 103, or the kit of paragraph 104, further comprising an inducer agent, repressor agent, guide nucleic acid, ligand for a sequestering domain, or ligand for an inducible promoter.
106. A method of modulating the expression of a target polypeptide, comprising:
   a) providing a population of cells comprising the polypeptide system of any one of paragraphs 1-20, or 43-88; and
   b) contacting the cells with the inducer agent or inducer signal for the inducible dimerization domain of the polypeptide system.
107. The method of paragraph 106, further comprising contacting the cells with a target nucleic acid encoding the target polypeptide, wherein the target nucleic acid comprises recombination sites specifically bound and cleaved by the active recombinase of the polypeptide system.
108. The method of paragraph 106 or 107, further comprising contacting the cells with a target nucleic acid encoding the target polypeptide, wherein the target nucleic acid comprises sites specifically bound and cleaved by the active sequence-specific nuclease of the polypeptide system.
109. The method of any one of paragraphs 106-109, further comprising contacting the cells with a guide nucleic acid for the active sequence-specific nuclease.
110. A method of treating a subject in need of a cell-based therapy, comprising:
   a) administering to the subject a population of cells comprising the polypeptide system of any one of paragraphs 1-20, or 43-88; and
   b) administering to the subject an effective amount of an inducer agent or inducer signal for the inducible dimerization domain.
111. The method of paragraph 110, further comprising administering a target nucleic acid encoding the target polypeptide, wherein the target nucleic acid comprises recombination sites specifically bound and cleaved by the active recombinase of the polypeptide system.
112. The method of paragraph 110 or 111, further comprising administering a target nucleic acid encoding the target polypeptide, wherein the target nucleic acid comprises sites specifically bound and cleaved by the active sequence-specific nuclease of the polypeptide system.
113. The method of any one of paragraphs 110-112, further comprising administering a guide nucleic acid for the active sequence-specific nuclease.
114. The method of any one of paragraphs 110-113, wherein, in the presence of the inducer agent or inducer signal for the inducible dimerization domain, the recombinase or sequence-specific nuclease is active.
115. The method of any one of paragraphs 106-114, wherein, in the absence of the inducer agent or inducer signal for the inducible dimerization domain, the recombinase or sequence-specific nuclease is inactive.
116. The method of any one of paragraphs 106-115, wherein the expression of the target polypeptide is increased when the active recombinase or active sequence-specific nuclease cleaves a portion of the target polynucleotide that inhibits expression of the target polypeptide.
117. The method of any one of paragraphs 106-116, wherein the expression of the target polypeptide is decreased when the active recombinase or active sequence-specific nuclease cleaves a portion of the target polynucleotide that induces expression of the target polypeptide or a portion of the target polynucleotide that encodes for the target polypeptide.
118. A method of modulating the expression of a target polypeptide, comprising:
   a) providing a population of cells comprising the polypeptide system of any one of paragraphs 21-33 or 43-88; and
   b) contacting the cells with a repressor agent or repressor signal for the repressible dimerization domain of the polypeptide system.
119. The method of paragraph 118, further comprising contacting the cells with a target nucleic acid encoding the target polypeptide, wherein the target nucleic acid comprises recombination sites specifically bound and cleaved by the active recombinase of the polypeptide system.
120. The method of paragraph 118 or 119, further comprising contacting the cells with a target nucleic acid encoding the target polypeptide, wherein the target nucleic acid comprises sites specifically bound and cleaved by the active sequence-specific nuclease of the polypeptide system.
121. The method of any one of paragraphs 118-120, further comprising contacting the cells with a guide nucleic acid for the active sequence-specific nuclease.
122. A method of treating a subject in need of a cell-based therapy, comprising:
   a) administering to the subject a population of cells comprising the polypeptide system of any one of paragraphs 21-33 or 43-88; and
   b) administering to the subject an effective amount of the repressor agent or repressor signal for the repressible dimerization domain.
123. The method of paragraph 122, further comprising administering a target nucleic acid encoding the target polypeptide, wherein the target nucleic acid comprises recombination sites specifically bound and cleaved by the active recombinase of the polypeptide system.
124. The method of paragraph 122 or 123, further comprising administering a target nucleic acid encoding the target polypeptide, wherein the target nucleic acid comprises sites specifically bound and cleaved by the active sequence-specific nuclease of the polypeptide system.
125. The method of any one of paragraphs 122-124, further comprising administering a guide nucleic acid for the active sequence-specific nuclease.
126. The method of any one of paragraphs 118-125, wherein, in the presence of the repressor agent or repressor signal for the repressible dimerization domain, the recombinase or sequence-specific nuclease is inactive.
127. The method of any one of paragraphs 118-126, wherein, in the absence of the repressor agent or repressor signal for the repressible dimerization domain, the recombinase or sequence-specific nuclease is active.
128. The method of any one of paragraphs 118-127, wherein the expression of the target polypeptide is increased when the active recombinase or active sequence-specific nuclease cleaves a portion of the target polynucleotide that inhibits expression of the target polypeptide.
129. The method of any one of paragraphs 118-128, wherein the expression of the target polypeptide is decreased when the active recombinase or active sequence-specific nuclease cleaves a portion of the target polynucleotide that induces expression of the target polypeptide or a portion of the target polynucleotide that encodes for the target polypeptide.
130. A method of modulating the expression of a target polypeptide, comprising:
   a) providing a population of cells comprising the polypeptide system of any one of paragraphs 34-37 or 43-88; and
   b) contacting the cells with the guide nucleic acids for the sequence-specific nucleases of the polypeptide system.
131. The method of paragraph 130, further comprising contacting the cells with the first and second target nucleic acids for the sequence-specific nucleases of the polypeptide system.
132. The method of paragraph 130 or 131, further comprising contacting the cells with a third target nucleic acid encoding the target polypeptide, wherein the target nucleic acid comprises recombination sites specifically bound and cleaved by the active recombinase of the polypeptide system.
133. A method of treating a subject in need of a cell-based therapy, comprising:
   a) administering to the subject a population of cells comprising the polypeptide system of any one of paragraphs 34-37 or 43-88; and
   b) administering to the subject an effective amount of the guide nucleic acids for the sequence-specific nucleases of the polypeptide system.
134. The method of paragraph 133, further comprising administering the first and second target nucleic acids for the sequence-specific nucleases of the polypeptide system.
135. The method of paragraph 133 or 134, further comprising administering a third target nucleic acid encoding the target polypeptide, wherein the target nucleic acid comprises recombination sites specifically bound and cleaved by the active recombinase of the polypeptide system.
136. The method of any one of paragraphs 130-135, wherein, in the presence of the guide nucleic acids and first and second target nucleic acids, the recombinase is active.
137. The method of any one of paragraphs 130-136, wherein, in the absence of the guide nucleic acids or first and second target nucleic acids, the recombinase is inactive.
138. The method of any one of paragraphs 130-137, wherein the expression of the target polypeptide is increased when the active recombinase cleaves a portion of the target polynucleotide that inhibits expression of the target polypeptide.
139. The method of any one of paragraphs 130-138, wherein the expression of the target polypeptide is decreased when the active recombinase cleaves a portion of the target polynucleotide that induces expression of the target polypeptide or a portion of the target polynucleotide that encodes for the target polypeptide.
140. A method of detecting a target nucleic acid, comprising:
   a) providing a population of cells comprising the polypeptide system of any one of paragraphs 34-37 or 43-88;
   b) contacting the cells with:
      i) the guide nucleic acids for the sequence-specific nucleases of the polypeptide system; and
      ii) a detection nucleic acid comprising:
         1. at least one recombinase recognition sequence (RRS); and
         2. the coding sequence for a detectable marker;
   c) detecting the detectable marker; and
   d) determining that the target nucleic acid is present in the cell if the detectable marker is detected, or determining that the target nucleic acid is not present in the cell if the detectable marker is not detected.
141. The method of paragraph 140, wherein the first and second sequence-specific nuclease ($N^A$ and $N^B$) in combination with their guide nucleic acids specifically bind to the target nucleic acid.
142. The method of paragraph 140 or 141, wherein the first and second polypeptide fragments of the recombinase are brought into close proximity, resulting in complementation of the two recombinase polypeptide fragments to form the active recombinase protein.

143. The method of any one of paragraphs 140-142, wherein the active recombinase protein specifically binds to the at least one RRS in the detection nucleic acid, causing a recombination event that allows for expression of the detectable marker polypeptide.

144. A method of modulating the expression of a target polypeptide, comprising:
   a) providing a population of cells comprising the polypeptide system of any one of paragraphs 38 or 43-88; and
   b) contacting the cells with the guide nucleic acid for the sequence-specific nuclease of the polypeptide system.

145. The method of paragraph 144, further comprising contacting the cells with a target nucleic acid encoding the target polypeptide, wherein the target nucleic acid comprises sites specifically bound and cleaved by the active sequence-specific nuclease of the polypeptide system.

146. The method of paragraph 144 or 145, further comprising contacting the cells with a target nucleic acid encoding the target polypeptide, wherein the target nucleic acid comprises recombination sites specifically bound and cleaved by the active recombinase of the polypeptide system.

147. A method of treating a subject in need of a cell-based therapy, comprising:
   a) administering to the subject a population of cells comprising the polypeptide system of any one of paragraphs 38 or 43-88; and
   b) administering to the subject an effective amount of the guide nucleic acid for the sequence-specific nuclease of the polypeptide system.

148. The method of paragraph 147, further comprising administering a target nucleic acid encoding the target polypeptide, wherein the target nucleic acid comprises sites specifically bound and cleaved by the active sequence-specific nuclease of the polypeptide system.

149. The method of paragraph 147 or 148, further comprising administering a target nucleic acid encoding the target polypeptide, wherein the target nucleic acid comprises recombination sites specifically bound and cleaved by the active recombinase of the polypeptide system.

150. The method of any one of paragraphs 144-149, wherein, in the presence of the guide nucleic acid and target nucleic acid(s), the recombinase and/or nuclease are active.

151. The method of any one of paragraphs 144-150, wherein, in the absence of the guide nucleic acid and target nucleic acid(s), the recombinase and/or nuclease are inactive.

152. The method of any one of paragraphs 144-151, wherein the expression of the target polypeptide is increased when the active recombinase or active sequence-specific nuclease cleaves a portion of the target polynucleotide that inhibits expression of the target polypeptide.

153. The method of any one of paragraphs 144-152, wherein the expression of the target polypeptide is decreased when the active recombinase or active sequence-specific nuclease cleaves a portion of the target polynucleotide that induces expression of the target polypeptide or a portion of the target polynucleotide that encodes for the target polypeptide.

154. The method of any one of paragraphs 106-153, wherein the first and/or second polypeptide further comprises a cytosolic sequestering domain.

155. The method of any one of paragraphs 106-154, further comprising contacting the cell with a ligand for the cytosolic sequestering domain.

156. The method of any one of paragraphs 106-155, further comprising administering a ligand for the cytosolic sequestering domain.

157. A method of modulating the expression of a target polypeptide, comprising:
   a) providing a population of cells comprising the polypeptide system of any one of paragraphs 40-88; and
   b) contacting the cells with a ligand for the cytosolic sequestering domain.

158. A method of treating a subject in need of a cell-based therapy, comprising:
   a) administering to the subject a population of cells comprising the polypeptide system of any one of paragraphs 40-88; and
   b) administering to the subject an effective amount of a ligand for the cytosolic sequestering domain.

159. The method of any one of paragraphs 154-158, wherein, in the presence of the ligand for the cytosolic sequestering domain, the first or second polypeptide is translocated to the nucleus.

160. The method of any one of paragraphs 154-159, wherein, in the presence of the ligand for the cytosolic sequestering domain, the first or second polypeptide binds to its cognate second or first polypeptide in the nucleus.

161. The method of any one of paragraphs 154-160, wherein, in the absence of the ligand for the cytosolic sequestering domain, the first or second polypeptide is not translocated to the nucleus.

162. The method of any one of paragraphs 154-161, wherein, in the absence of the ligand for the cytosolic sequestering domain, the first or second polypeptide does not bind to its cognate second or first polypeptide in the nucleus.

163. The method of any one of paragraphs 106-162, wherein the first and/or second polypeptide is operatively linked to an inducible promoter.

164. The method of any one of paragraphs 106-163, further comprising contacting the cell with a ligand for the inducible promoter.

165. The method of any one of paragraphs 106-164, further comprising administering a ligand for the inducible promoter.

166. A method of modulating the expression of a target polypeptide, comprising:
   a) providing a population of cells comprising the polynucleotide or polynucleotide system of any one of paragraphs 93-97; and
   b) contacting the cells with a ligand for the inducible promoter.

167. A method of treating a subject in need of a cell-based therapy, comprising:
   a) administering to the subject a population of cells comprising the polynucleotide or polynucleotide system of any one of paragraphs 93-97; and
   b) administering to the subject an effective amount of a ligand for the inducible promoter.

168. The method of any one of paragraphs 163-167, wherein, in the presence of the ligand for the inducible promoter, the first and/or second polypeptide is expressed.

169. The method of any one of paragraphs 163-168, wherein, in the absence of the ligand for the inducible promoter, the first and/or second polypeptide is not expressed.
170. The system of any one of paragraphs 1-20 or 43-88 or the method of any one of paragraphs 106-117, wherein there is a lag time of 30 seconds or less in between protein complementation of the two polypeptide fragments in the presence of the inducer agent or inducer signal and the protein being in its active state.
171. The system of any one of paragraphs 21-33 or 43-88 or the method of any one of paragraphs 118-129, wherein there is a lag time of 30 seconds or less in between protein complementation of the two polypeptide fragments in the absence of the repressor agent or repressor signal and the protein being in its active state.
172. The system of any one of paragraphs 21-33 or 43-88 or the method of any one of paragraphs 118-129, wherein there is a lag time of 30 seconds or less in between protein un-complementation of the two polypeptide fragments in the presence of the repressor agent or repressor signal and the protein being in its inactive state.
173. The system of any one of paragraphs 34-37 or 43-88 or the method of any one of paragraphs 130-143, wherein there is a lag time of 30 seconds or less in between protein complementation of the two polypeptide fragments in the presence of the guide nucleic acids and the protein being in its active state.
174. The system of any one of paragraphs 38 or 43-88 or the method of any one of paragraphs 144-156, wherein there is a lag time of 30 seconds or less in between protein complementation of the two polypeptide fragments in the presence of the guide nucleic acid and the protein being in its active state.
175. The system of any one of paragraphs 40-88 or the method of any one of paragraphs 157-165, wherein there is a lag time of 30 seconds or less in between nuclear translocation in the presence of the ligand for the sequestering domain and the protein being in its active state.
176. The polynucleotide or polynucleotide system of any one of paragraphs 93-97 or the method of any one of paragraphs 166-169, wherein there is a lag time of 30 seconds or less in between the ligand binding to the inducible promoter and the start of transcription of the polynucleotide operatively linked to the inducible promoter.
177. The polynucleotide or polynucleotide system of any one of paragraphs 93-97 or the method of any one of paragraphs 166-169, wherein there is a lag time of 30 minutes or less in between the ligand binding to the inducible promoter and the start of translation of the polypeptide encoded by the polynucleotide operatively linked to the inducible promoter.

EXAMPLES

Example 1: Inducible Control of Gene Expression in Mammalian Systems

Synthetic regulation of gene expression is a powerful tool in biotechnology that allows the development of a wide variety of applications, ranging from decoding natural cell signaling pathways to programming living cells for therapeutic benefits. To grant users control of gene expression, scientists have expanded their tool box by coupling different gene regulatory elements such as site specific recombinases (SSRs) with custom signaling modules. Scientists can use a library of inducible SSRs utilizing chemical, light, and temperature-inducible dimerization domains; see e.g., Weinberg et al. Nature communications, 10(1), 1-10 (2019), the content of which is incorporated herein by reference in its entirety. To extend the library of inducible gene regulatory tools, described herein are recombinases that can be activated with non-toxic, readily available, clinically approved molecules such as caffeine, grazoprevir, and danoprevir. These new tools can be readily translatable to be used in vivo as research tools and therapeutic switches to provide digital control over gene expression. Also described herein are inducible regulatory tools that control gene expression in the analog mode by splitting the RNA targeting nuclease Cas13d. The designed system can knock down multiplexed target gene expression with the targeting specificity provided by gRNA in a tunable and reversible manner.

Project Summary

Genetic engineering has revolutionized the field of biotechnology by improving research tools utilized in studies of fundamental biology and by permitting new applications such as programmed cell therapy. Although early successes have been achieved through constitutive ectopic gene expression, such as in the clinically approved chimeric antigen receptor T cell therapy for lymphoblastic leukemia, more complexed circuitry that integrates precise control of expression level and protein activity brings targeted functionality improvements, such as increased efficiency and safety in the cases of therapeutics. For example, in cases of off-target attacking by chimeric antigen receptor (CAR) T cells toward healthy tissues, it has been speculated that the constitutive activity of the CAR T cells led to their accumulation and reactivity in the lung, a vital organ they passed early after infusion, without even reaching the tumor target. In this case, delaying of functional CAR expression until the engineered T cells reach target site through spatiotemporal control can enhance therapeutic outcome by limiting off-target toxicity on healthy tissues, and increase on-target efficacy. The isolated, user-defined spatiotemporal control of gene expression can be achieved by gene expression regulatory effectors integrated with customized signal-responsive modules.

Various regulatory elements have been discovered and harnessed from the abundant and essential gene regulation processes in nature to achieve synthetic regulation of gene expression. With different intrinsic features of the regulators, different control profiles are available ranging from the digital and irreversible DNA modification such as that offered by recombinases to the analog, reversible, post-transcriptional control of expression achieved by the clustered regularly interspaced short palindromic repeats (CRISPR) Cas13 systems and small RNAs. While digital computation generates robust output after making a permanent decision, the analog mode of regulation is more suited to mimic the complex computation in living cells. Therefore, depending on the mode of computation desired, the appropriate regulators can be chosen.

As a powerful tool in the field of genetic engineering, site specific recombinases have been used to program living cells to process complexed input information and execute user-defined functions ranging from signal sensing and recording to biofuel and therapeutic biochemical production. These enzymes are able to recognize specified sequence and perform deletion, inversion, and insertion of DNA between those sites. The recombination sites have been used to flank various building blocks in the process of gene transcription, which allows gene expression regulation through the manipulation of recombinase activity. Moreover, the availability of the orthogonal recombinase/recombination site systems and their conditioned activity permits the design of robust and sophisticated gene circuits, which is essential for cells embedded with these circuits to perform complexed target function autonomously and reliably. In addition, since the proof of site specific recombinases (SSRs) performing complete DNA recombination in vivo, they have been widely employed as a research tool for the tailoring of animal genome. Loss- or gain-of-function mutation studies permitted by recombinase systems also facilitated the study of specific gene functions in vivo and the establishment of accurate animal models for a large number of human diseases such as Parkinson's disease and cancer. See e.g., Ham et al. (2006) Biotechnology and bioengineering, 94(1), 1-4; Ham et al. (2008) PLoS One, 3(7); Santos et al. (2013) Nature communications, 4(1), 1-10; Calos (2006) Current gene therapy, 6(6), 633-645; Siuti et al. (2013) Nature biotechnology, 31(5), 448-452; Bonnet et al. (2013) Science, 340(6132), 599-603; Lakso et al. (1992). PNAS, 89(14), 6232-6236; Yang et al. (2008). Journal of immunological methods, 337(2), 81-87; Ventura et al. (2007) Nature, 445 (7128), 661-665; Schönhuber et al. (2014) Nature medicine, 20(11), 1340; Zhuang et al. (2005) Journal of neuroscience methods, 143(1), 27-32; the contents of each of which are incorporated herein by reference in their entireties.

With the expanding natural RNA-targeting gene expression regulators and the demand to distribute control of gene expression to different layers of regulation, translational regulation has been utilized to fine-tune computation performance of complexed circuits, to sense disease associated signals, and to improve safety and efficiency of cell therapy. Since the uncovering of its programmable RNA-targeting feature of the CRISPR/Cas13 system in various organisms, this system has been utilized to achieve visualization of transcripts in vivo, RNA editing, and RNA virus detection and inhibition. Additionally, this protein-based regulator can be coupled with well-characterized signaling modules to achieve user-controlled enzyme activity.

(1) low leakage activity without the trigger and (2) robust activation upon induction. Thus, splitting the effector ensures physical separation of the split halves at an off state, in order to shut down leakage activity and to allow accumulation of effector splits before induction, which leads to a more rapid start of reaction. In addition, a variety of split sites within an effector can generate customized activity profiles with different signal sensitivity and effector-target affinity. Moreover, since the discovery of rapamycin induced dimerization domains, many chemical induced dimerization (CID) domains have been discovered and exploited in the regulation of gene expression (see e.g., Table 1). The variety of unique and orthogonal CID domains and regulators allow users to rationally design inducible gene regulatory systems that are the most suitable for specific applications, which is essential for the advancement in biotechnological and biomedical applications. Described herein are libraries of split recombinases that are responsive to temperature, light, and chemical, leveraging understanding in designing inducible split proteins. See e.g., Ausländer et al. (2012) Nature, 487(7405), 123-127; Weinberg et al., 2019, supra; the contents of each of which are incorporated herein by reference in their entireties. Also described herein is an expanded library of inducible gene regulators, which are characterized herein, demonstrating their application in different contexts.

Described herein is an expanded library of small chemical inducible split SSRs for systems that are more readily translatable to therapeutic applications. Specifically described herein are split recombinases that are inducible by clinically approved small molecules, such as caffeine, danoprevir, and grazoprevir. Performance characterization can be done in the perspective of plasmid dosage (e.g., expression level), drug dosage, system orthogonality, and induction time. It is contemplated herein that to demonstrate the unique benefit that the caffeine inducible recombinase system brings, the caffeine inducible Cre can be delivered to the brain of a Cre reporter mouse line, and its performance is characterized in vivo (see e.g., FIG. 3A). The grazoprevir and danoprevir inducible recombinases can be applied in a

TABLE 1

Exemplary Chemically Induced Dimerization (CID) Domains.

| Ligand | Origin | Toxicity* | Potential endogenous target | Dimerization domain size (gene) | Dissociation constant (Kd) | Reversibility | Mechanism of action |
|---|---|---|---|---|---|---|---|
| Rapamycin | Immune suppressant | no | yes | 0.5 kb | 0.4 nM | hardly | Dimerization |
| Gibberellin | Plant hormone | yes | no | 1.3 kb | 1 uM | yes | Dimerization |
| Abscisic acid | Plant hormone | no | no | 1.6 kb | 0.02 uM | yes | Dimerization |
| Tamoxifen | Anti-estrogen | no | yes | 1 kb | | hardly | Nuclear transportation |
| Caffeine | Psycho-active drug | no | yes | 0.4 kb | 1.2 uM | yes | Dimerization |
| Grazoprevir | Anti-viral drug | no | no | 1.3 kb | 0.02 nM | yes | Dimerization |

"*" indicates toxicity in mammalian systems at working concentration; see e.g., Mofty et al. Nutr Cancer 1994, 21(2):183-90; Miyamoto et al. (2012) Nature chemical biology, 8(5), 465; Hao et al. (2011) Mol Cell. 2011 Jun. 10, 42(5):662-72; Franco et al. (2010) Journal of Chromatography B, 878(2), 177-186; Harper et al. (2012) ACS medicinal chemistry letters, 3(4), 332-336; Bojar et al. (2018) Nature communications, 9(1), 1-10; Foight et al. (2019) Nature biotechnology, 37(10), 1209-1216; the contents of each of which are incorporated herein by reference in their entireties.

In order to achieve exogenous signal responsive activity, the approach of splitting effector enzyme and fusing the split halves with inducible dimerization domains can be adopted due to the few advantages this system possesses. An optimal inducible gene switch possesses the properties of generating:

therapeutic context to control permanent state change in CAR-T cells (see e.g., FIG. 3B).

Also described herein are inducible split Cas13 proteins that control gene expression on the RNA transcript level. The knockdown activity of Cas13 can be characterized with different targets, guides, and effector protein dosage. With an understanding of Cas13's knockdown ability and the variety of available chemical induced dimerization (CID) systems, split Cas13 effectors are designed either with or without the capability of being induced by extrinsic signals. To demonstrate the therapeutic applications of inducible Cas13, the system is incorporated to improve CAR-T cell therapy by tuning expression level of gene such as human leukocyte antigen (HLA) and programmed cell death 1 (PD-1).

I. Inducible Recombinases

SSRs have been widely employed as a research tool for the tailoring of animal genome in vivo and the establishment of accurate animal models for a large number of human diseases such as Parkinson's disease and cancer. However, pseudo recombination sites have been found in the mouse genome, and the constitutive expression of recombinases have been found to be toxic, which has led to severe consequences such as chromosomal aberration and growth arrest. Due to the irreversibility of the DNA recombination reaction, recombinase activity need not be constitutive, and inducible systems can achieve a targeted DNA editing effect as well as a constitutive recombinase, without as much toxicity. Additionally, inducible recombinase systems provide temporal control of gene modification, which circumvents possible early lethal phenotypes and allow gene function studies at different developmental stages.

To obtain such temporal control of recombinase activity, recombinase location and conformation have been modified for the rapid control of its activity. The Cre-ERT2 system moves Cre into the nucleus for DNA modification upon binding the antiestrogen molecule, tamoxifen. Although this system has robust control over recombinase activity in various tissues, and has generated numerous time- and tissue-specific mouse mutants, it suffers from leaky Cre activity without tamoxifen treatment and the time delay caused by the transportation and accumulation of Cre in the nucleus. An alternative approach to split recombinase comprises fusing rapalog CIDs with fragmented Cre recombinase the inducibility of the system has been demonstrated. Although rapamycin has been used to induce protein proximity for the cell signaling studies and inducible tools to program cell functions, the biggest problem of its use as the trigger for recombinase splits dimerization is the irreversibility due to its strong affinity to its binding domains (see e.g., Table 1). Thus, a more reversible system is at demand. CID systems found in plants, such as abscisic acid (ABA) and gibberellin (GIB) possess, are beneficial not only due to their fast and reversible dimerization action, but also due to the lack mammalian endogenous targets (see e.g., Table 1). As the number of available CID systems grow, users are offered with choices to achieve customized manner of induction and multiplexed spatiotemporal control over complexed recombinase based circuits. See e.g., Feil et al. (2009). Inducible cre mice. In *Gene knockout protocols* (pp. 343-363), Humana Press; Kim et al. (2018) *Laboratory animal research*, 34(4), 147-159; Spencer et al. (1993) *Science*, 262(5136), 1019-1024; the contents of each of which are incorporated herein by reference in their entireties.

Caffeine, as a non-toxic, readily available, small molecule that can cross through the highly selective blood brain barrier, has been recognized as a great candidate to be applied in mammalian synthetic biology applications. An exemplary system comprises a synthetic gene switch that detects and responds to caffeine at a physiological relevant level by activation of a caffeine dependent transcription factor; see e.g., Bojar et al. (2018) *Nature communications*, 9(1), 1-10; the content of which is incorporated herein by reference in its entirety. Single-domain anti-caffeine camelid nanobodies (CaffVHHs) were fused to DNA binding and transcription activation domains to achieve caffeine-induced gene expression. In one aspect, described herein is a recombinase-based caffeine-inducible genetic switch. These caffeine inducible recombinases were built, and it is contemplated herein that its advantage can be demonstrated by viral delivery of the system to mouse brain and characterization of system performance in vivo.

NS3a is hepatitis C virus (HCV) protease that has been the target of multiple drugs such as grazoprevir and danoprevir. PROCISiR is an engineered control switch, wherein engineered "reader" proteins specifically target the grazoprevir or danoprevir/NS3a complex (GNCR or DNCR); see e.g., Foight et al. (2019) supra. The system is useful as both drugs are not only clinically approved, but they also have no endogenous mammalian targets. As NS3a offers post-translational control of protein activity traditionally through protease-based approaches with limited speed of action, the utilization of a catalytically dead NS3a in the PROCISiR system not only eliminated the requirement protein accumulation, but also minimized the possibility of off-target proteolytic activity. The system has demonstrated its capability to redirect protein location and to provide graded and proportional control of gene transcription and cell signaling. The PROCISiR system can be used in the design of inducible chimeric antigen receptors (CAR) to program behavior of CAR-T cells for safer and more effective cancer treatment, and it has shown early success in regulating CAR activity; see e.g., International Patent Application PCT/US2020/025200, which is incorporated herein by reference in its entirety. While this approach offers the benefit of reversible and graded regulation of CAR activity, a regulation mode able to retain memory that does not require the prolonged drug induction is needed with cell therapy in the patient, necessitating permanent alterations. As such, in one aspect described herein are grazoprevir- and danoprevir-inducible split recombinases (chosen from a library of split recombinases) that can facilitate permanent state change in CAR-T cells.

1. Caffeine Inducible Recombinase

Cre Split at 270271 Showed the Best Performance when Recruited by CaffVHH Domains.

Figure 1A:
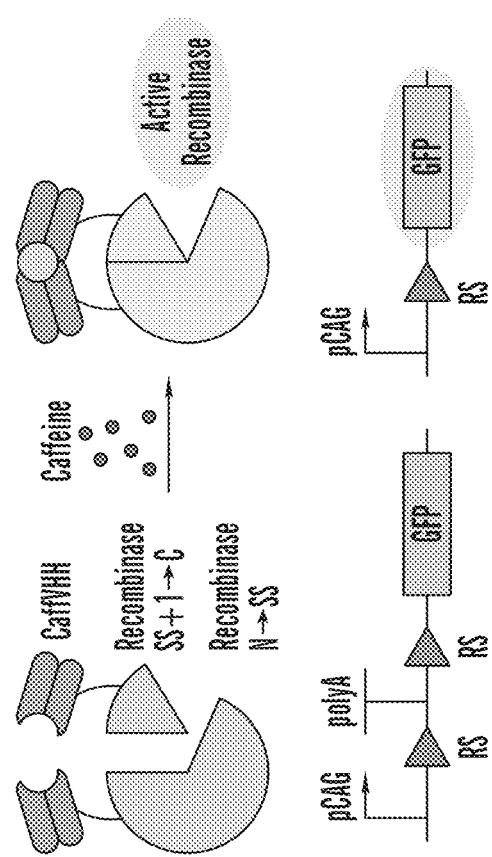

To build caffeine inducible split recombinases, 4 split sites were selected in Cre that generate moderate to good on/off dynamic range with the gibberellin inducible system, and the CID domains were swapped with the CaffVHH domain (see e.g., FIG. 1A). Recombination performance remained consistent with the same split pair between dimerization domains; Cre 270/271 gave the best recombination efficiency with caffeine and the least leaky activity without inducer (see e.g., FIG. 1B). In addition, to verify that no split was functioning on its own, single split moiety was transfected with reporter without its counterpart. No reporter expression was found in conditions either with or without caffeine induction, indicating that both moieties are required for successful recombination. Certain Cre split pairs when coupled with the rapalog (RAP) inducible system (which has a size comparable to CaffVHH domain) generated nearly constitutive active systems; this leaky activity was not as notable when the same split pair was coupled with GIB and ABA CID domains. Without wishing to be bound by theory, it is hypothesized that such split sites lead to Cre moieties that self-dimerize and perform recombination without recruitment by CID domains, and the small size of RAP CID and CaffVHH domains cannot keep Cre splits separated like large GIB and ABA CID domains. Thus, to identify split Cre that can be recruited together only upon caffeine induction, split sites were screened that generated low basal activity with various inducible systems. Split site 270/271 demonstrated the best inducibility. To capture the time window at physiological related caffeine concentrations for the split recombinase to be turned on, recombination efficiency was tested with various caffeine doses and induction times (see e.g., FIG. 1C, FIG. 1D). It was found that 0.1 uM caffeine was able to turn on Cre activity and generate reporter expression in 48 hours (see e.g., FIG. 1C). In addition, when induced with the maximum physiological relevant caffeine concentration (25 uM) for 5 hours (the clearing rate of the caffeine from human bodies), the inducible Cre was able to turn on Cre reporter expression in ~30% of transfected cells (see e.g., FIG. 1D).

Both Recruitment Domains and Split Sites Made a Difference in the Performance of the Inducible Split Recombinase System.

To optimize the recombination efficiency, a tandem CaffVHH domain was generated where 2 CaffVHHs are linked together as the recruitment domain; the nucleic acid encoding one of the CaffVHHs is codon optimized to avoid homologous recombination with the nucleic acid encoding the other tandem CaffVHH. Dose response experiments were performed on the single CaffVHH split Cre versus tandem CaffVHH domains, and the results indicated that tandem CaffVHH split Cre 270/271 outperformed its single CaffVHH version by up to 13 fold upon induction with the same induction conditions. Additionally, tandem CaffVHH split Cre was more sensitive in that it achieved maximum recombination efficiency with 20 uM caffeine, while single CaffVHH achieved similar, if not less, efficiency with 500 uM caffeine (see e.g., FIG. 2C).

Figure 2A:
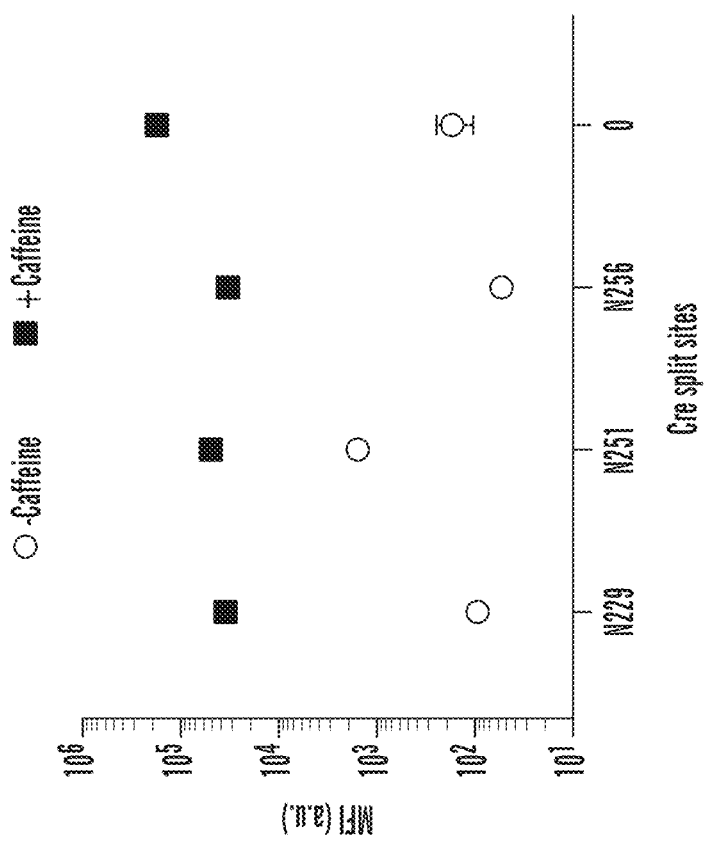
FIG. 2A-2C is a series of schematics and graphs showing that caffeine-induced dimerization was compatible with a variety of split recombinases.
Figure 2A:
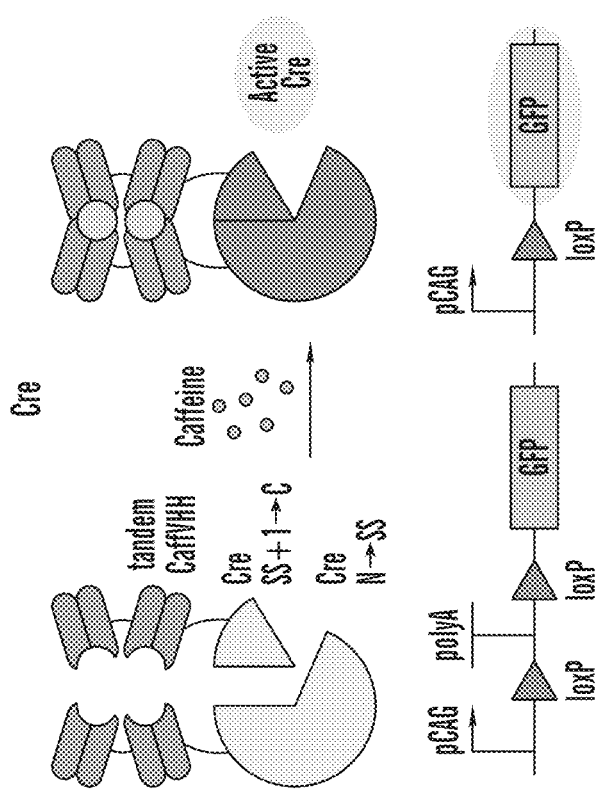
Figure 2A:
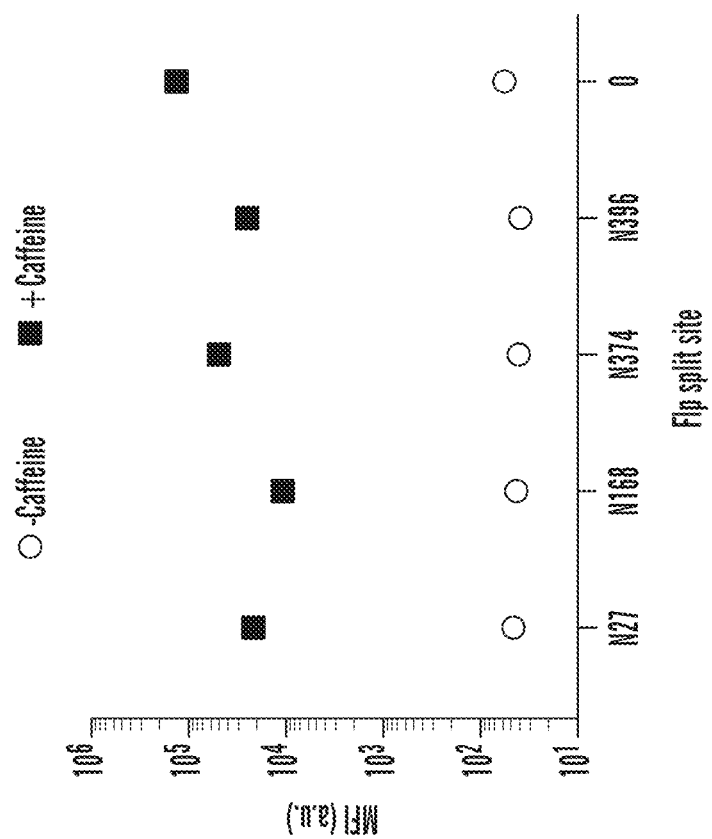
Figure 2A:
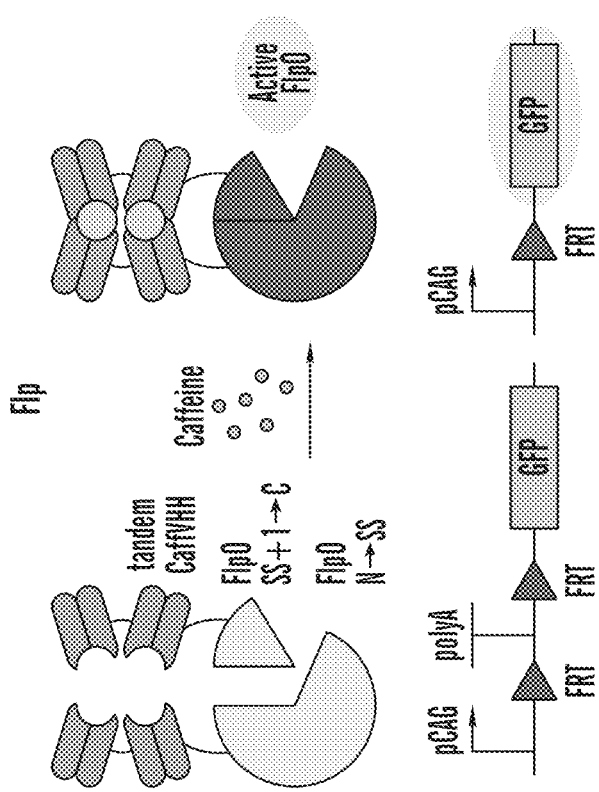
Figure 2A:
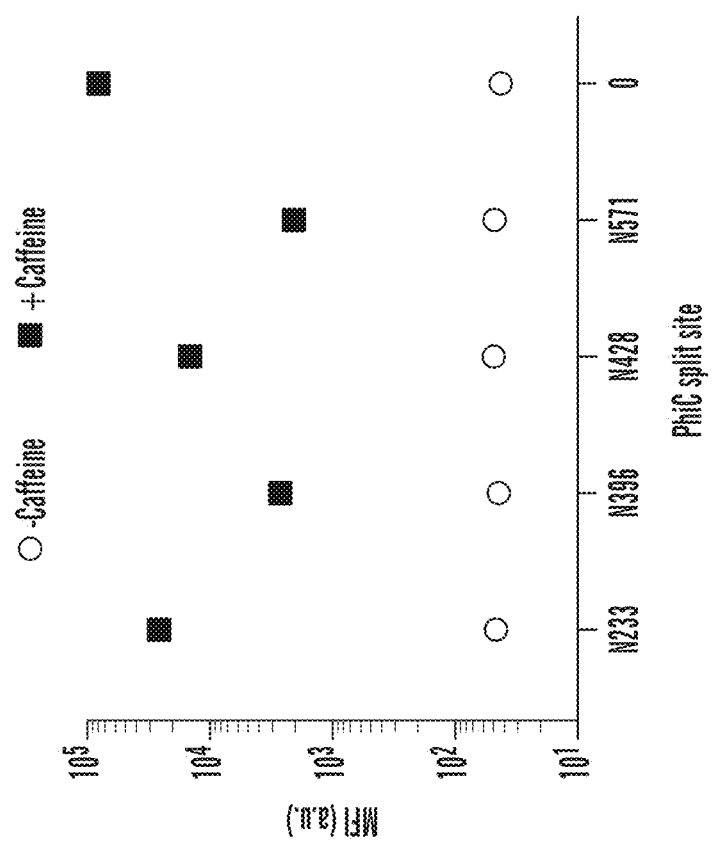
Figure 2A:
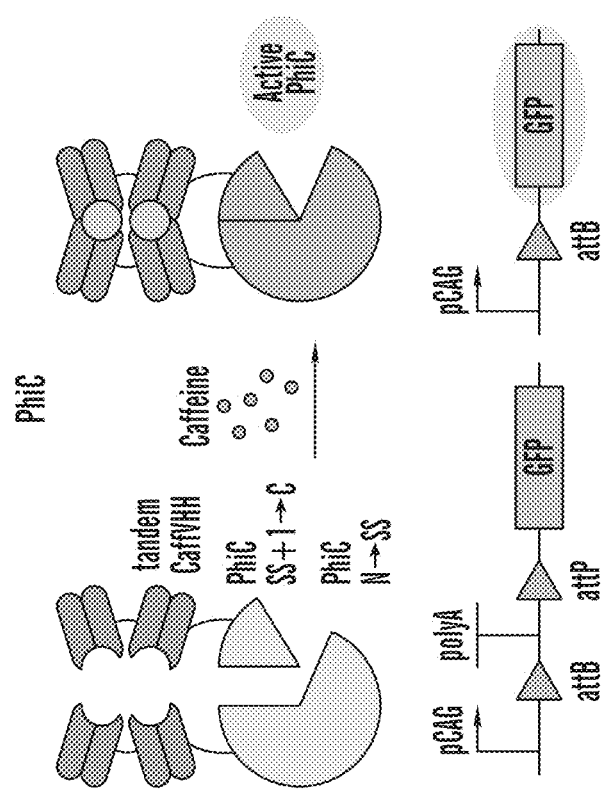
Figure 2A:
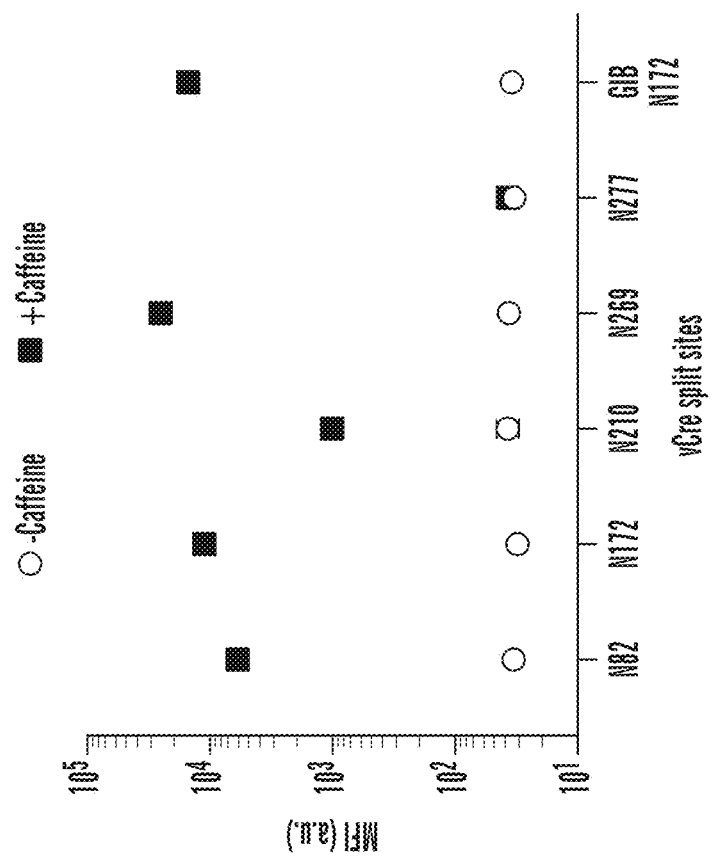
Figure 2A:
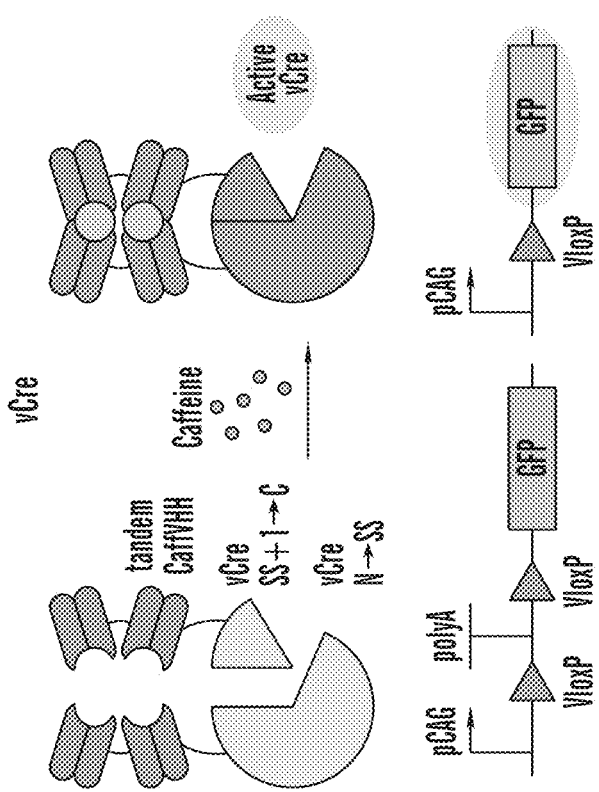
Figure 2B:
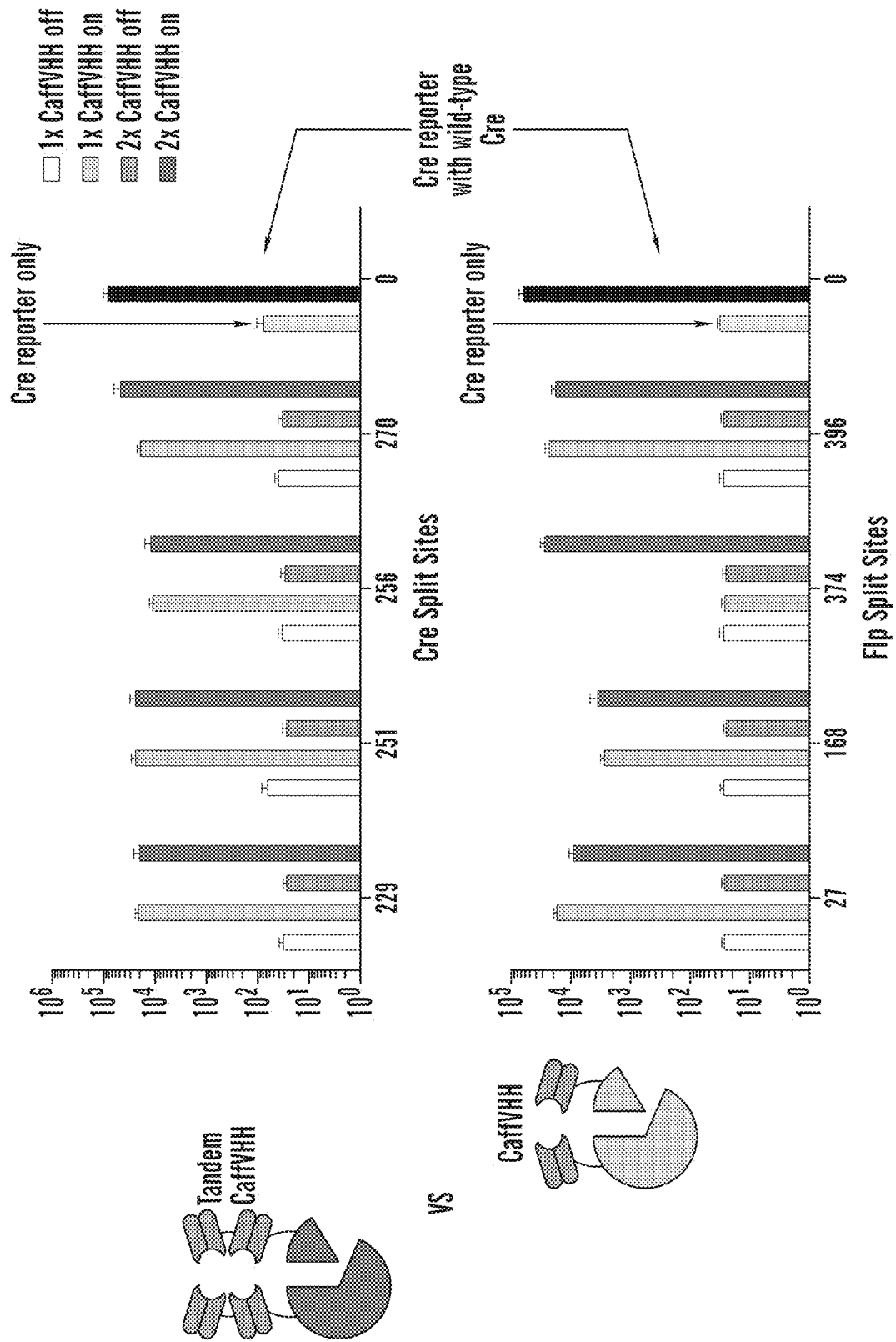
Figure 2C:
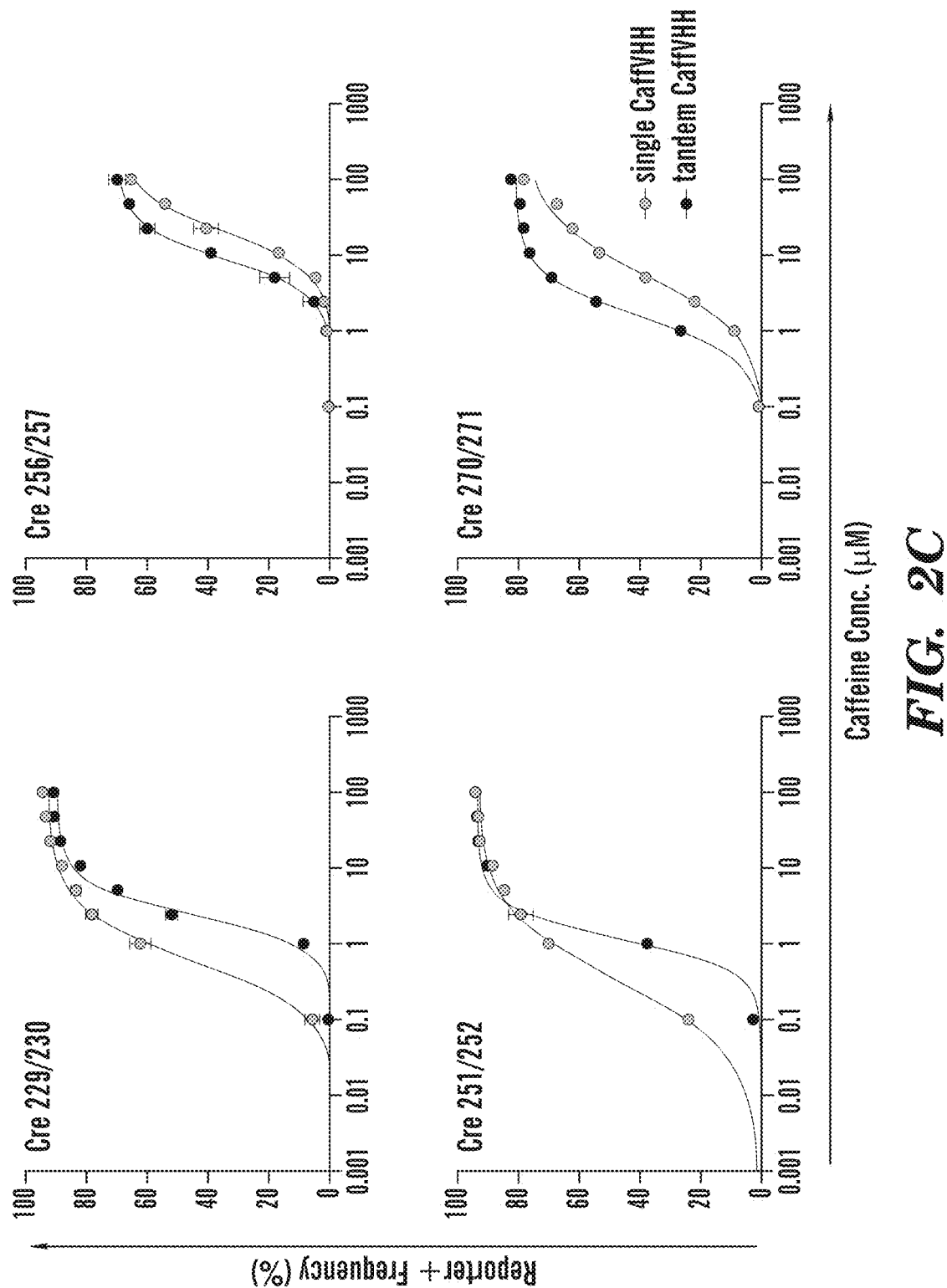

Flp, PhiC, and vCre were also screened, each with 4 selected splits sites with the tandem CaffVHH domain, and at least one split pair for Flp, PhiC, or vCre exhibited recombination activity only upon caffeine induction (see e.g., FIG. 2A). After achieving success with tandem CaffVHH as the recruitment domain for split recombinases, recombination performance was then compared between single and tandem CaffVHH domains across different split recombinase pairs. With 48 hours of 100 uM caffeine induction, results showed that tandem CaffVHH was able to generate comparable induced recombination, if not better (see e.g., Flp split 374/375), as compared to single CaffVHH (see e.g., FIG. 2B). Considering the high caffeine dosage and long induction time in this experiment, system sensitivity and early-on potency might have been lost. Therefore, this problem was resolved by using a range of caffeine dosages and reducing the induction time to 24h. Results showed that not all split recombinases had better potency and sensitivity when linked with tandem CaffVHH (see e.g., FIG. 2C; e.g., Cre 229/230 or Cre 251/252 showed increased reporter activation at lower caffeine concentrations when linked to tandem CaffVHH as compared to CaffVHH, whereas Cre356/357 or Cre270/271 did not). Overall, described herein are split recombinases, which when linked to single CaffVHH (or tandem CaffVHH) have sub micro molar sensitivity to caffeine.

In Vitro Characterization of the Caffeine Inducible Recombinase

To determine whether or not the increasing trend in recombination when multiple inducer binding sites are used as the dimerization domain is due to increased expression levels, the quantity of the split recombinase protein expression can be confirmed (e.g., single versus tandem CaffVHH domains). If the expression level is similar between single and multiple inducer binding sites, expression can be excluded from affecting recombination efficiency. It is contemplated herein that different epitope tags can be added to the split recombinase pair, and western blot studies can be performed with HEK-293 FT cells transfected with the same amount of constructs that express recombinase splits with single versus tandem CaffVHH domains. Band intensity for both split moieties can be quantified relative to the expression of a control gene. If the codon optimized version of the CaffVHH domains cannot be expressed at a comparable level to the original (non-codon-optimized version of the CaffVHH domain), it is contemplated herein that more codon optimized version of the CaffVHH domains can be tested.

Besides providing strong ON activity during induction, an optimal inducible gene switch generates minimal leakage activity in conditions without signal input. This is especially important in genetic editing tools used in vivo as the duration of animal experiments are often long. Therefore, it is contemplated herein that performance of these caffeine inducible recombinase over time, particularly the leakage activity, can be characterized. HEK 293 FT cells can be transfected with split recombinases and the corresponding reporter, and the cells can be induced with caffeine or the vehicle control for 100 hours before being collected for flow cytometry measurement. Signal to noise ratio can be used as the measurement incorporating both the off-drug leakage recombination and the induced recombination activity. The CreERT2 system, which can be used in animal models for controlled gene expression, can be tested as the positive control.

In Vivo Functionality of the Caffeine Inducible Recombinase in Animal Models.

The small size of the caffeine inducible recombinases allows them to be packed in to the versatile adeno associate virus, which has a wide range of tissue tropisms. First, it is contemplated herein that a construct that expresses common fluorescent proteins under a constitutive promoter can be used to optimize AAV packaging. To verify and validate the produced virus, first virus can be titered using rt-PCR with primers targeting the inverted terminal repeat (ITR) sequence in AAV vector, and then transduction on primary neuron cells can be tested in vitro. Additionally, virus carrying intact recombinase sequence, recombinase reporter, and the split recombinases can be produced and validated in vitro before in vivo experiments. When packing both split moieties in a single virus to achieve all-in-one delivery, in order to avoid homologous recombination caused by the identical sequence of CaffVHH domains, it is contemplated herein that one CaffVHH can be replaced with its codon optimized version that can be expressed at comparable level as the original (non-codon-optimized) version. Virus carrying intact Cre versus caffeine inducible split Cre can then be delivered in the Ai6-ZsGreen Cre-reporter mouse line, and infected mice can then be divided into groups with and without caffeine induction. Histological analysis of mice brain tissue can be done to show successful recombination (see e.g., FIG. 3A).

2. Grazoprevir and Danoprevir (NS3) Inducible Recombinase

Design and Characterization of NS3 Inducible Recombinase

To couple the 2 signaling modules in the PROCISiR system with split recombinases, it is contemplated herein that 4 split sites can be selected in FlpO that have worked well with other inducible systems (see e.g., FIG. 2A). NS3a can be fused with one terminal moiety of a split recombinase, and either the GNCR or DNCR can be fused to the complementary split recombinase piece to achieve grazoprevir and danoprevir inducibility. The orientation of the dimerization domains can affect the performance of the designed system. Thus, reversed attachment of the reader protein and NS3a to the split pieces can also be explored. Initial characterization of the NS3 recombinases can be done in HEK293FT cells through polyethylenimine (PEI) transient transfection. Dose and temporal response studies can be conducted to select the best-performing NS3-recombinase.

Testing System Performance with FLEX Switch in T Cells to Turn on CAR Expression Conditionally Due to Cre-related toxicity in Jurkat cells, inducible FlpOs are utilized in experiments involving T cells. First, it is contemplated herein that the performance of the previously selected inducible FlpO can be tested by electroporation of the inducible FlpO and reporters into Jurkat cells, and the optimal experimental conditions such as drug dosage and required time of induction can be determined. Once performance of the inducible FlpOs are validated in Jurkat cells, the constructs can be used to control T cell activity by replacing the FlpO reporters with the ON CAR recombinase-based flip-excision (FLEX) switches (see e.g., FIG. 3B). Activation of the FLEx switch with recombinase begins with an unstable inversion step followed by a stable excision step, effectively removing one sequence of DNA and inverting another. Due to the configuration and of recombination sites in the final product, this stable inversion switch can only be performed one time; see e.g., Chakravarti et al. (2019). ACS synthetic biology, 8(8), 1744-1754, the contents of which are incorporated herein by reference in their entirety). Both FlpO and the FLEX switch can be transduced into Jurkat cells using lentivirus. Recombinase activity in cells transduced with the inducible FlpO and FLEX switch can be evaluated by measuring the CAR expression in conditions with the corresponding drug induction. Successful recombination can also be tested and demonstrated by the function of CARs at activating NFAT regulated GFP expression in Jurkat cells when exposed to its target antigens. To further demonstrate the advance of the grazoprevir and danoprevir inducible recombinase in translation to clinical studies, it is contemplated herein that the system performance can be tested in primary T cells. CAR expression and indicators of T cell activation, such as IL-2 secretion, upon antigen recognition can also be tested to evaluate recombination performance.

Figure 9:
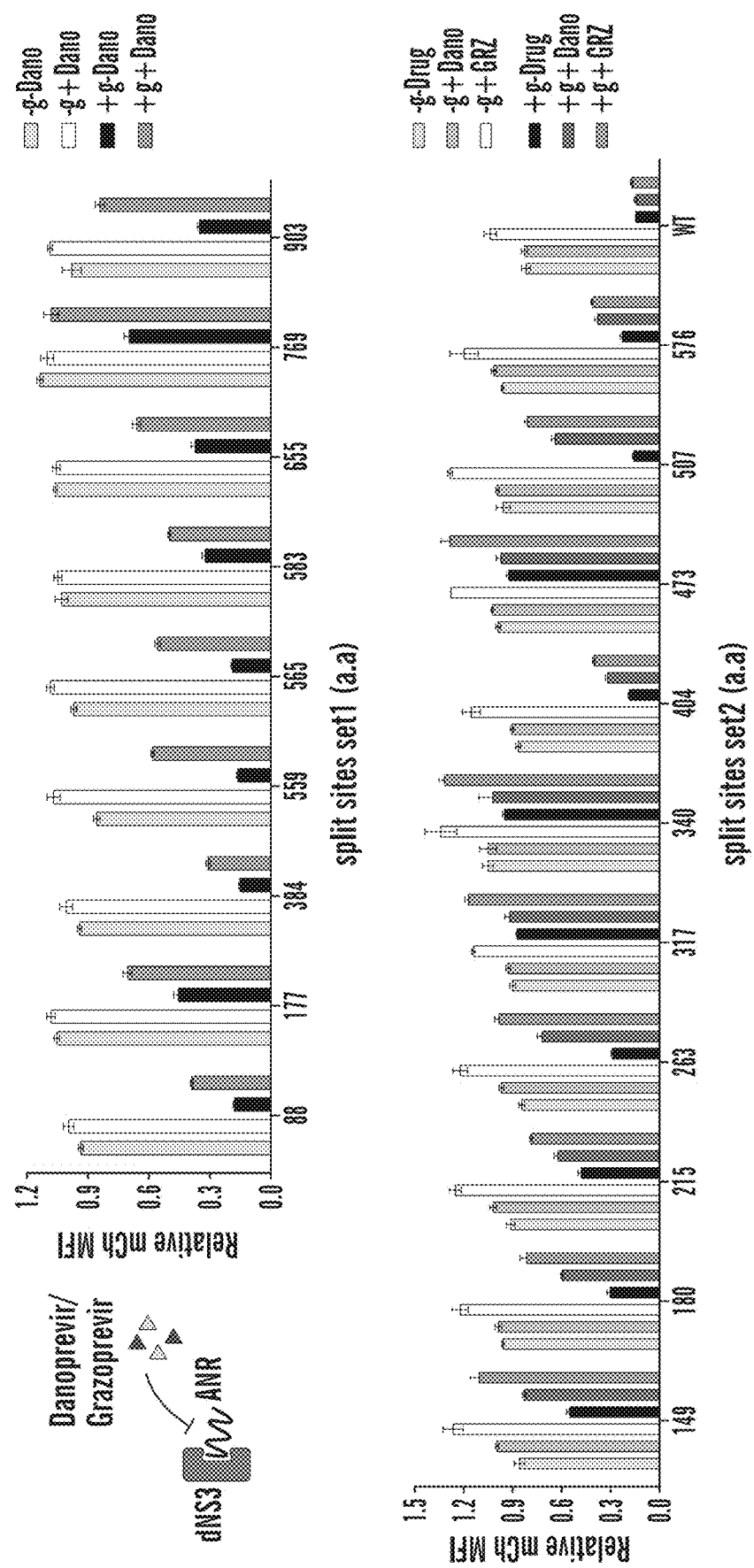
FIG. 9 is a series of schematics and bar graphs showing a drug inducible Cas13d OFF switch. Two protein domains, e.g., dNS3 and ANR, constitutively bind to each other. As danoprevir and grazoprevir compete for binding to dNS3, the ANR becomes unbound, which leads to the separation of the linked Cas13d split pair. mCherry expression with or without gRNA under drug or no drug conditions across tested split sites are shown. Split sites in the second set (see e.g., bottom bar graph) were tested with both danoprevir (see e.g., $2^{nd}$ and $5^{th}$ bars in each split site) and grazoprevir (see e.g., $3^{rd}$ and $6^{th}$ bars in each split site), while systems with the first set of splits (see e.g., top bar graph) were tested with danoprevir only (see e.g., $2^{nd}$ and $4^{th}$ bars in each split site). The left-right order of the bars for each split site is the same as the top-down order of the legend for each bar graph.

Regarding the caffeine inducible recombinases, it is contemplated herein that lentivirus can also be used as the delivery vehicle in vivo, as lentivirus can be successfully packaged with validated virus function in cell types such as HEK293FT, Jurkat, and primary T cells. In terms of designing split recombinases that show high performance with the NS3 inducible systems (e.g., DNCR, GNCR), recombinase split pairs can be used that provide inducibility with the NS3 system, which is based on the fact that split recombinases have been rendered inducible by RAP, ABA, GIB, Caffeine, or even without recruitment domains. However, if high ON/OFF dynamic range cannot be achieve just using the split system, the off-drug leakage can be further shut off by sequestering one recombinases moiety from the nucleus (see e.g., FIG. 7B-7C). Furthermore, the apo NS3a reader (ANR) which basally complexes with the unbound NS3a can be utilized to anchor recombinase split far from its complementary piece. Upon induction, inducers not only serve to bring the complementary splits together, but it can also drive the dislocation of the ANR anchored split by binding to NS3a and inhibit ANR association (see e.g., FIG. 9).

II. Inducible Cas13d

While SSRs are invaluable tools for constructing complex logic circuits and provide control of therapeutic gene expression, its use to perturb endogenous gene expression is restricted due to the lack of their recombination recognition sites in mammalian genome. In addition, although the digital computation that generates either "ON" or "OFF" output is relatively straightforward and discrete, the analog computational mode is also essential as it provides continuous modulation of gene expression. Therefore, it is important to study intrinsic cellular pathways that exhibit analog properties and to apply such expression profiles to engineering cellular activity. For example, programmed death 1 (PD-1) is one of the inhibitory surface receptors expressed by antigen specific T cells after being activated. PD-1 silencing through shRNA and CRISPR-Cas9 has shown enhanced tumor cell killing efficiency in vitro, and PD-1 silencing resulted in prolonged survival of animals bearing PD-L1 positive tumor xenograft. However, PD-1 disrupted the CAR T cell is still susceptible to exhaustion, and long-term durability of the therapy remains to be improved. Additionally, as PD-1 is expressed upon T cell activation and upregulated in long-term stimulation, PD-1 is also an indicator of tumor infiltrating T cells that are highly specific and reactive. Studies have shown that only the PD-1 positive tumor infiltrating T cells inhibited tumor growth in vivo instead of the PD-1 negative fraction from the same T cell population. The ambiguous role of PD-1 in T cell anti-cancer avidity indicates that fine-tuned expression of PD-1 in a user defined manner is essential to gaining more insights on the role of PD-1 in T-cell-mediated cancer clearance and can lead to an improved therapeutic outcome. In addition, although PD-1 silencing has led to enhanced anti-tumor efficacy by CAR T cells, the mechanism behind is yet to be investigated, which can also benefit from a gene expression regulator that generates modifications in a conditional, reversible, and analog manner. See e.g., Rupp et al. (2017) *Scientific reports*, 7(1), 1-10; McGowan et al. (2020) *Biomedicine & Pharmacotherapy*, 121, 109625; Odorizzi et al. (2015) *Journal of Experimental Medicine*, 212(7), 1125-1137; Gros et al. (2014) *The Journal of clinical investigation*, 124(5), 2246-2259; Gros et al. (2016) Nature medicine, 22(4), 433-438; the contents of each of which are incorporated herein by reference in their entireties.

Targeting DNA for such endogenous gene silencing renders challenges for the system such as multiplexed gene-targeting, restrictions from epigenetic conformation, and delayed response; gene silencing at the RNA level fills the void when such situations are undesired. Class 2 type-VI CRISPR/Cas systems are prokaryotic immune systems that target and cleave foreign RNAs for survival in viral infections. These systems are composed of a single effector protein, Cas13, and a guide RNA (gRNA) through which target specificity of the system can be easily programmed by having a spacer sequence complementary to the target. Additionally, Cas13 possesses the ability to process a pre-CRISPR RNA array for multiplexed knockdown activity. There are at least 4 subtypes of Cas13: Cas13a-d, among which, Cas13a, Cas13b, and Cas13d do not require any protospacer flanking sequence (PFS) for efficient gene targeting in mammalian cells, thus, are less restricted in potential target sites. In particular, Cas13d has attracted great interest due to its small size and robust cleavage in vitro. Furthermore, the Cas13 ortholog, Cas13d from *Ruminococcus flavefaciens* (referred to herein as RfxCas13d or simply Cas13d), showed 85-90% knockdown of mCherry and endogenous gene expression in mammalian cells with better specificity and less off-target effect than a conventional shRNA regulator. Although shRNA shows great knockdown efficiency when used either to study gene functions or regulate therapeutic gene expression, induced shRNA expression in order to gain temporal control of knockdown activity has been limited to the coupling of a class III promoter with Tet responsive elements due to its RNA nature. However, Cas13d, as an effector protein, has much greater potential for controlled activity, either through transcriptional or post translational control. See e.g., Abudayyeh et al. (2016) Science, 353(6299); Cox et al. (2017) Science 358(6366), 1019-1027; Konermann et al. (2018) Cell, 173(3), 665-676; the contents of each of which are incorporated herein by reference in their entireties.

Described herein is a system comprising a small chemical inducible split RfxCas13d that is only functional with the presence of an inducer and gene-targeting gRNA; it is contemplated herein that this system can have comparable on-target knockdown efficacy to the wild type RfxCas13d and no significant off-target or off-inducer activity. To demonstrate the applications for the inducible split RfxCas13d, the inducible knockdown system can be applied in primary T cells to control gene expression of multiple therapeutic relevant genes simultaneously.

1. Design of an Inducible Split Cas13d

Characterization of Cas13d and Establishment of Experimental Design

Figure 4A:
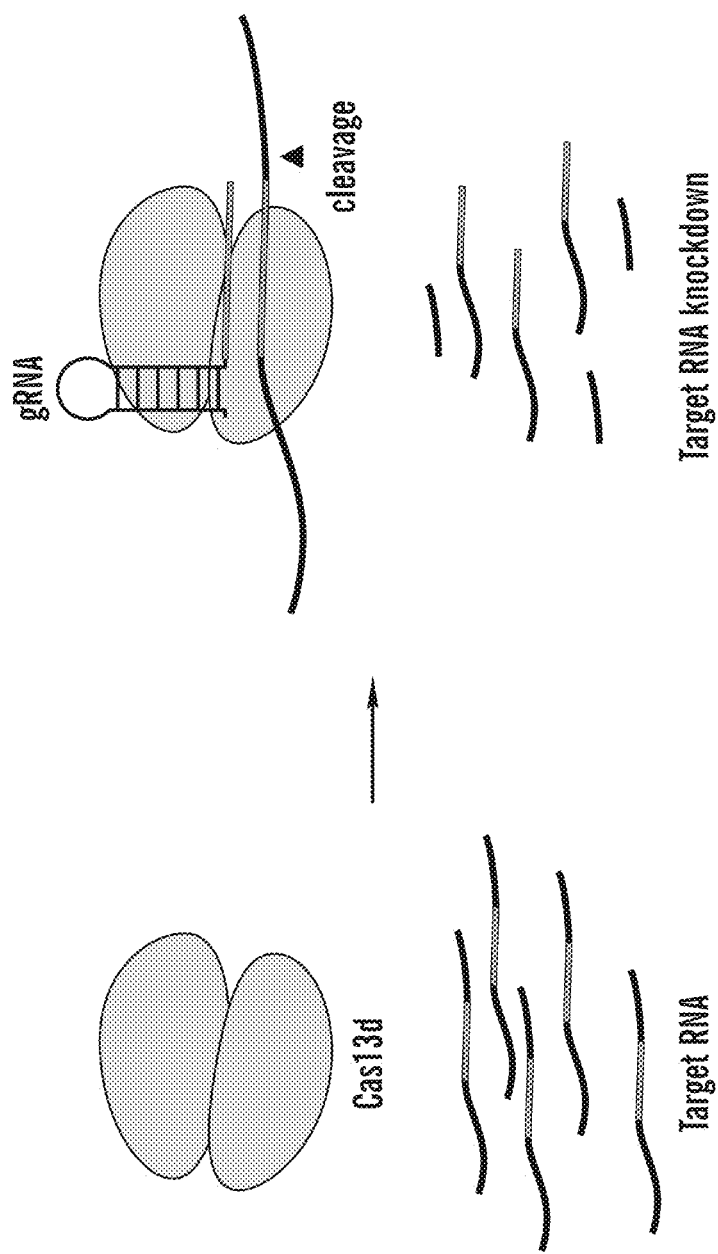
FIG. 4A-4D is a series of schematics and graphs showing that Cas13d achieved robust transgene knockdown in HEK 293 FT cells.
Figure 4B:
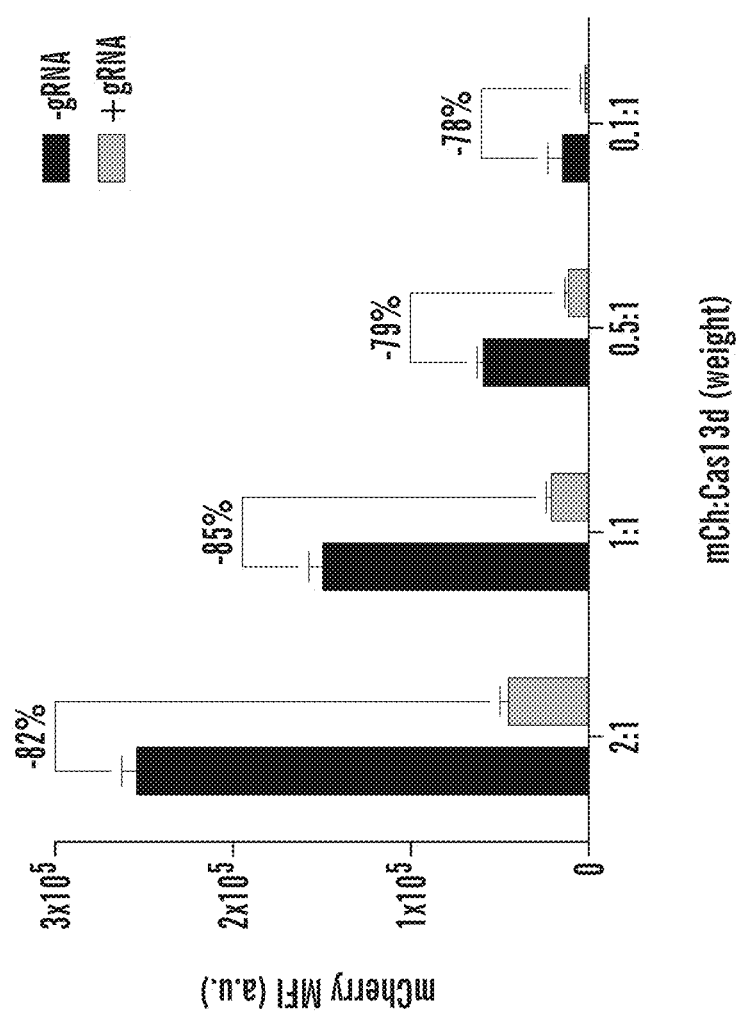
Figure 4D:
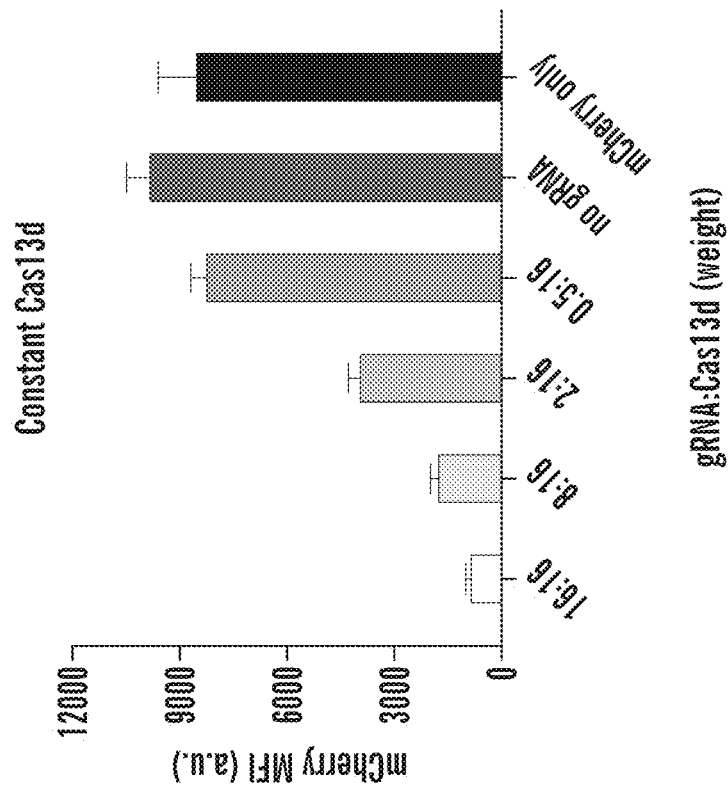
Figure 4C:
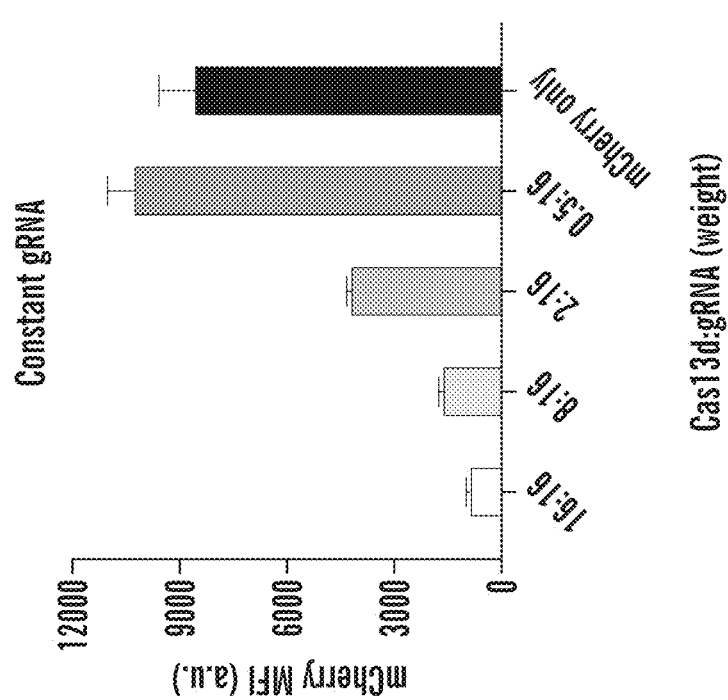

In order to gain better understanding of the activity of the Cas13 effector/gRNA system, it was first examined how variation in the expression of each components (e.g., target, guide, and/or effector protein) relate to the knockdown efficiency of the system. HEK 293 FT cells were transiently transfected with the components of the system, and expression of the targeted gene, mCherry, was tested using flow cytometry. After gating for the live and transfected cell population, cells transfected with a target:effector ratio from 0.1:1 to 2:1 showed similar knockdown efficiency toward the constitutively expressed target gene (see e.g., FIG. 4B). In addition, data showed that decreasing the dose of either Cas13 protein or guide RNA in experiments with a constant dosage of target resulted in diminished knockdown activity, indicating that both components were essential and neither played a dominating role (see e.g., FIG. 4C, FIG. 4D). These results indicate that knockdown performance can be tuned through titrating the expression level of the components in the system. Another important feature of Cas13d is its ability to process pre-mature gRNA arrays and achieve multiplexed gene targeting. To verify this, pre-gRNAs with spacer regions flanked by 2 direct repeat sequences were transfected with Cas13d into HEK 293 FT cells. Target gene knockdown was later quantified and compared to that by mature gRNAs. Results showed that the knockdown efficiency by pre-mature gRNAs was slightly less efficient but comparable to that by mature gRNA, which may be explained by the extra time for pre-gRNA to be processed before facilitating knockdown.

Figure 5A:
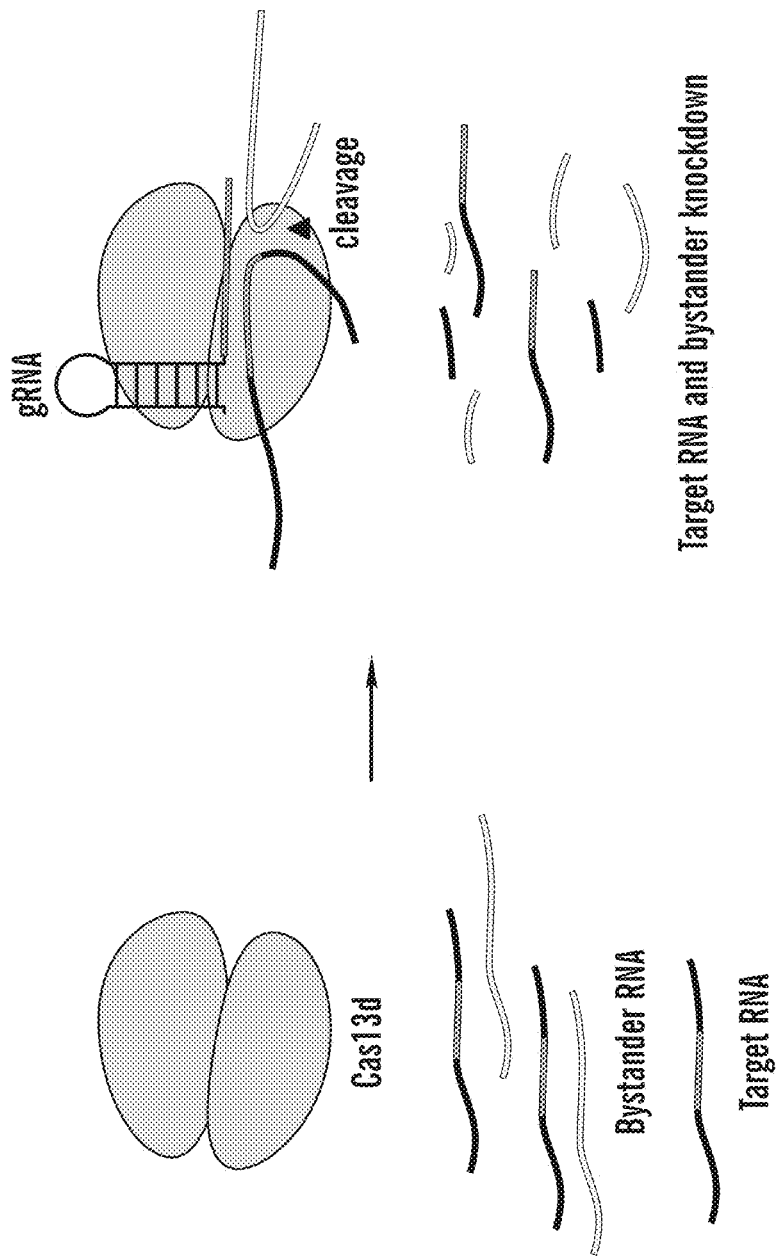
FIG. 5A-5C is a series of schematics and graphs showing collateral activity of Cas13d.
Figure 5B:
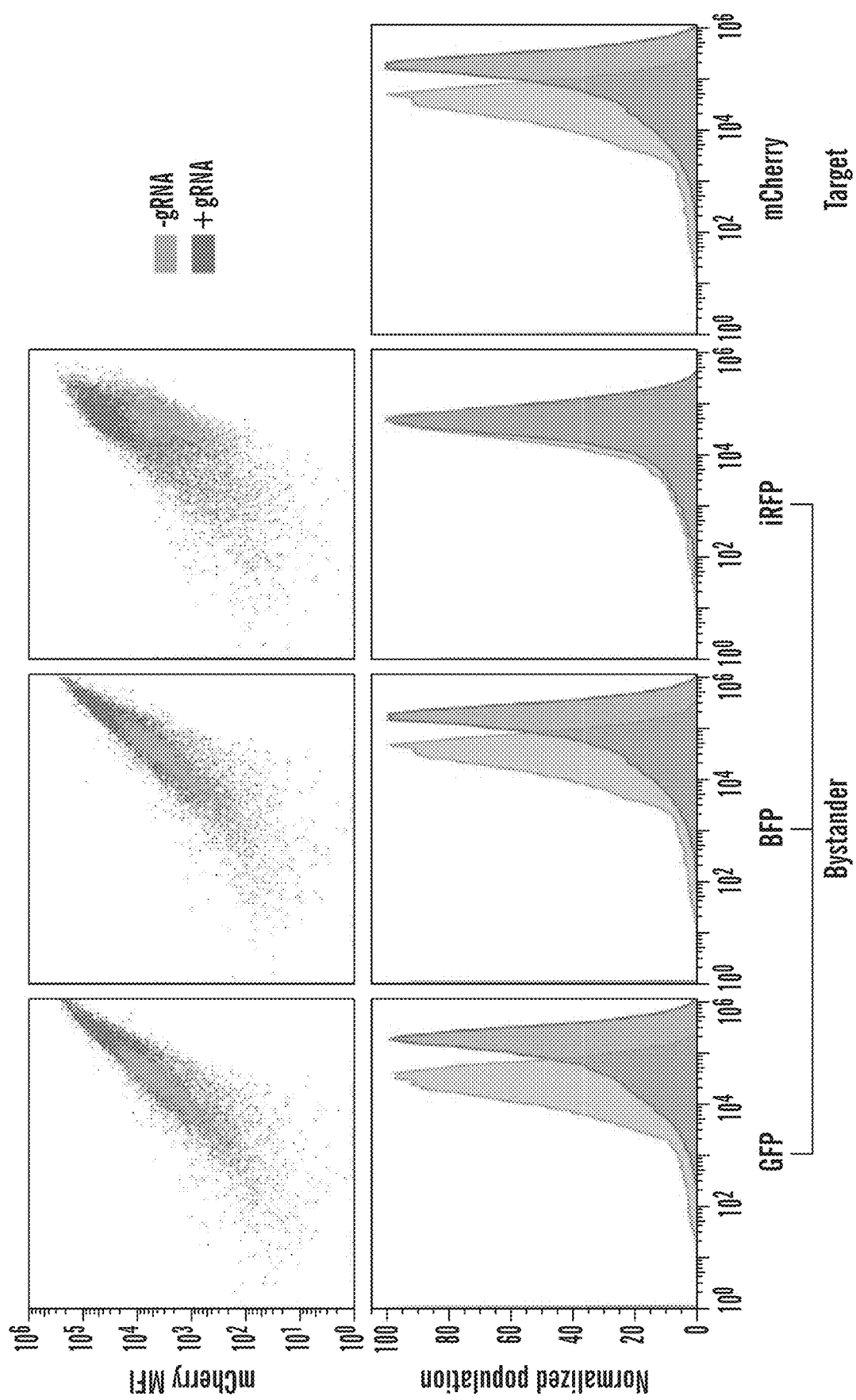

The green fluorescent protein (GFP) was used initially as a transfection marker and as a non-targeted gene expression control. Comparing GFP expression in groups with and without mCherry targeting Cas13d system, GFP expression was knocked down along with mCherry (see e.g., FIG. 5B). Although Cas13 is known to have collateral activity and perform non-specific cleavage of surrounding RNAs in vitro and in prokaryotes, RfxCas13d along with some orthologs of Cas13a and Cas13b, did not show detectable collateral activity in mammalian and plant cells; see e.g., Abudayyeh et al. (2016) supra; Cox et al. (2017) supra; Konermann et al. (2018) supra. GFP was knocked down by Cas13d only when mCherry was present, confirming that this is a collateral activity instead of a result from non-specific gRNA design. In addition, although mCherry-targeting gRNA did not target GFP in the absence of mCherry, GFP collateral cleavage did vary with different gRNAs, which did not show correlation with the mCherry knockdown ability of Cas13d with corresponding gRNAs. It was also tested if the collateral activity was only limited to GFP, and it was found that BFP was also strongly affected, while iRFP expression level was the least disturbed, indicated that the collateral activity by Cas13d is biased among different bystanders (see e.g., FIG. 5B).

Figure 5C:
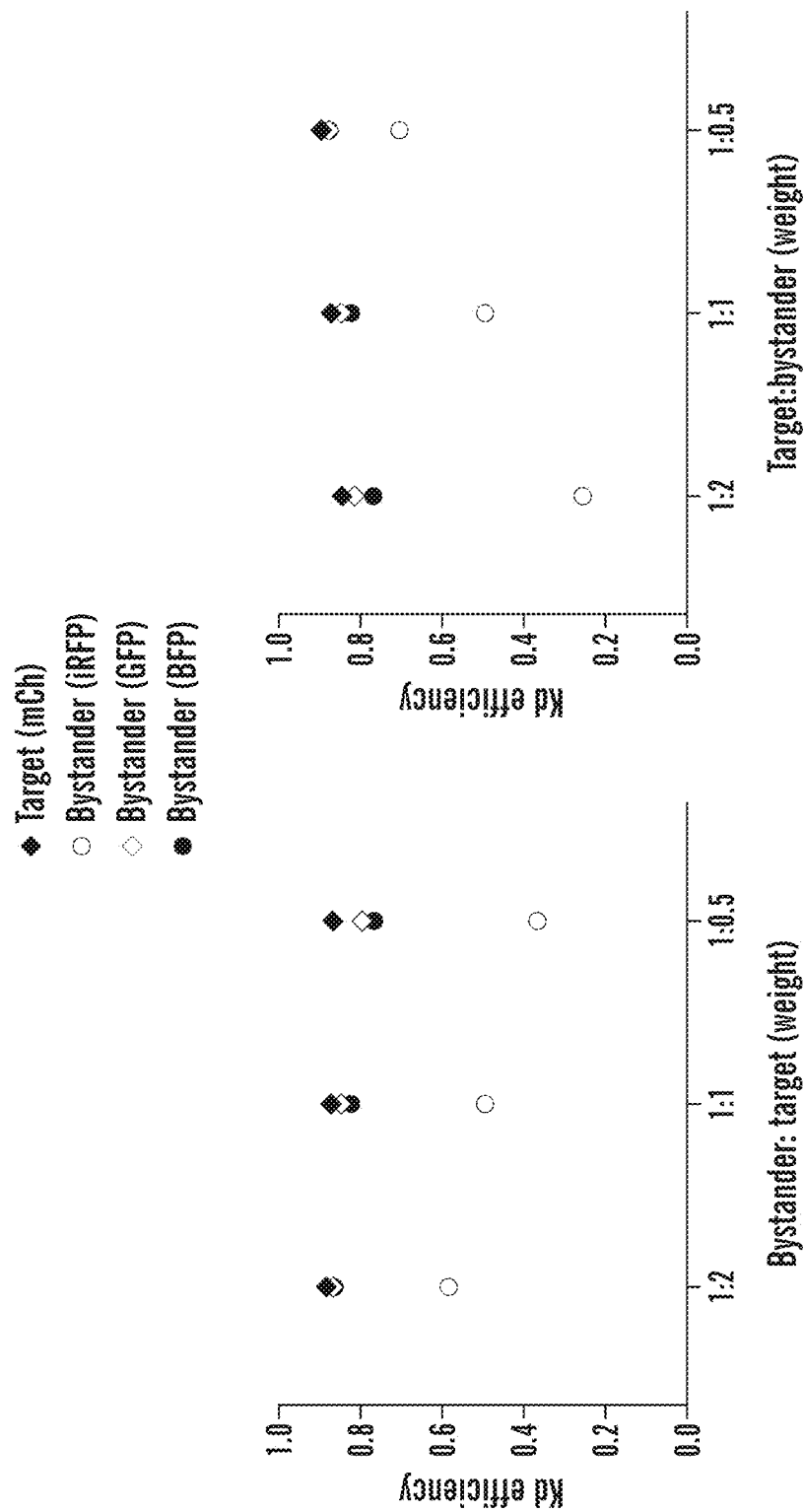

Furthermore, with the target gene (mCherry) being held consistent, an increased dose of bystander fluorescent proteins resulted in less efficient collateral knockdown, which indicates that the collateral cleavage is a less efficient reaction relative to on-target cleavage. On the other hand, decreased target dose also reduced collateral activity, which is reasonable as the target gene serves as the inducer of collateral cleavage activation (see e.g., FIG. 5C). Thus the collateral effects of Cas13d in mammalian cells, especially on endogenous genes, can be further investigated.

Selecting Split Sites on RfxCas13d and Testing Splits with Different CID Systems.

To achieve spatiotemporal control of the knockdown activity, small chemical inducible RfxCas13s are designed with the careful selection of split sites in the RfxCas13d effector protein. It is contemplated herein that such a system can only be functional with the recruitment by CID domains upon induction.

The secondary structure of an analogous Cas13d ortholog, *Eubacterium siraeum* Cas13d (EsCas13d), was used to predict the structure of RfxCas13d through HHPred alignment. Split sites were selected to avoid conserved residues among Cas13d orthologs, secondary structures, and catalytic domains. In addition, as the cleavage activity of Cas13 effector requires the dimerization of the 2 catalytic domains, most split sites were selected to be in between these catalytic domains, so that either terminal moieties would not have constitutive RNA cleavage capability on their own (see e.g., FIG. 6A). Moreover, some deletions on the external surface of the effector protein does not result in adverse effect on Cas13d cleavage activity; see e.g., Zhang et al. (2018) Cell, 175(1), 212-223, the content of which is incorporated herein by reference in its entirety. Therefore, split sites within these regions should not disturb critical structures for the functionality of Cas13d (see e.g., FIG. 6A). Split fragments were obtained through polymerase chain reaction (PCR) and dropped into backbones with CID domains such as the GIB, ABA, or RAP inducible systems; see e.g., Weinberg et al. 2019, supra. The final cloning product for each split site are 2 constructs, where N terminal Cas13 fragment was fused with GID, ABI, or FRB domains on the C-terminal end, and the C-terminal Cas13 fragment was fused to GAI, PYL, or FKBP domains on its N-terminal end. Paired constructs were transiently transfected into HEK 293 FT cells for screening, with the targeted transcript (e.g., mCherry), targeting/non-targeting gRNAs, and the transfection marker, iRFP. All gene expression was driven by CAG promoter except for gRNAs, which were under control of U6 promoters. Media with 5× inducer or vehicle control was added 2 hours after PEI transfection for a final drug concentration of 1× or none. Cells were collected, and flow cytometry measurements were taken 48 hours after induction. Controls where only the N or C-terminal constructs were transfected were included to demonstrate any constitutive activity retained by any split moiety. Split Cas13d pairs coupled with GIB CID domains generated the best induced performance; ABA CIDs also achieved efficient knockdown activity and RAP CIDs lead to high basal knockdown induced by gRNA (see e.g., FIG. 6B). Moreover, split Cas13d's 559/560, 565/566, and 655/656 performed efficient knockdown with each of the various CID domains (see e.g., FIG. 6B); without the help of any of the 3 CID domains, these split pairs also achieved gRNA induced target knockdown with efficiency up to 80% (see e.g., FIG. 6C). The wide distribution of gRNA binding residues throughout the effector sequence may have contributed to the automated dimerization through gRNA. In addition, results showed that no N or C terminal moiety by itself (i.e., without its corresponding C or N terminal moiety) with or without recruitment domains achieved significant knockdown of target gene; even split sites chosen so that one moiety includes both catalytic domains of Cas13d (e.g., splits 89C, 178C, or N903) did not lead to target knockdown without the help of their complementary moieties (see e.g., FIG. 6C).

2. Endogenous Gene Knockdown by Cas13d

Controlled endogenous gene knockdown can be performed by using the inducible split Cas13d's described herein in mammalian cells; therapeutic gene targets can be regulated in primary T cells, such as PD-1, HLA, and/or IL-2R. First, the knockdown activity of WT RfxCas13d toward endogenous genes is validated in HEK cells. HEK 293FT cells were transiently transfected with B2M targeting gRNA, a transfection marker, and WT RfxCas13 or the RAP inducible split RfxCas13 pair 565/566. 48 hours after transfection, cells were collected and stained with HLA-A2 antibody for flow cytometry measurement. After gating for cells that were live and expressing transfection marker strongly, HLA-A2 surface expression was deficient in 67% cells transfected with both RfxCas13 and B2M-targeting gRNA, and the knockdown efficiency was related to the dose of Cas13 plasmid transfected. Moreover, the split Cas13 also achieved comparable decrease in HLA-A2 expression level with B2M-targeting gRNA without decreasing transfection marker expression. Cas13 was capable of knocking down HLA-A2 expression to a great extent in some cells, comparable to the unstained WT HEK 293FT cells. The rest of the population retained their HLA-A2 expression level. As HLA-A protein is known to have a slow turn-over rate of several days, experiments with longer knockdown time and experiments showing knockdown activity dynamics over time can be conducted.

Figure 24:
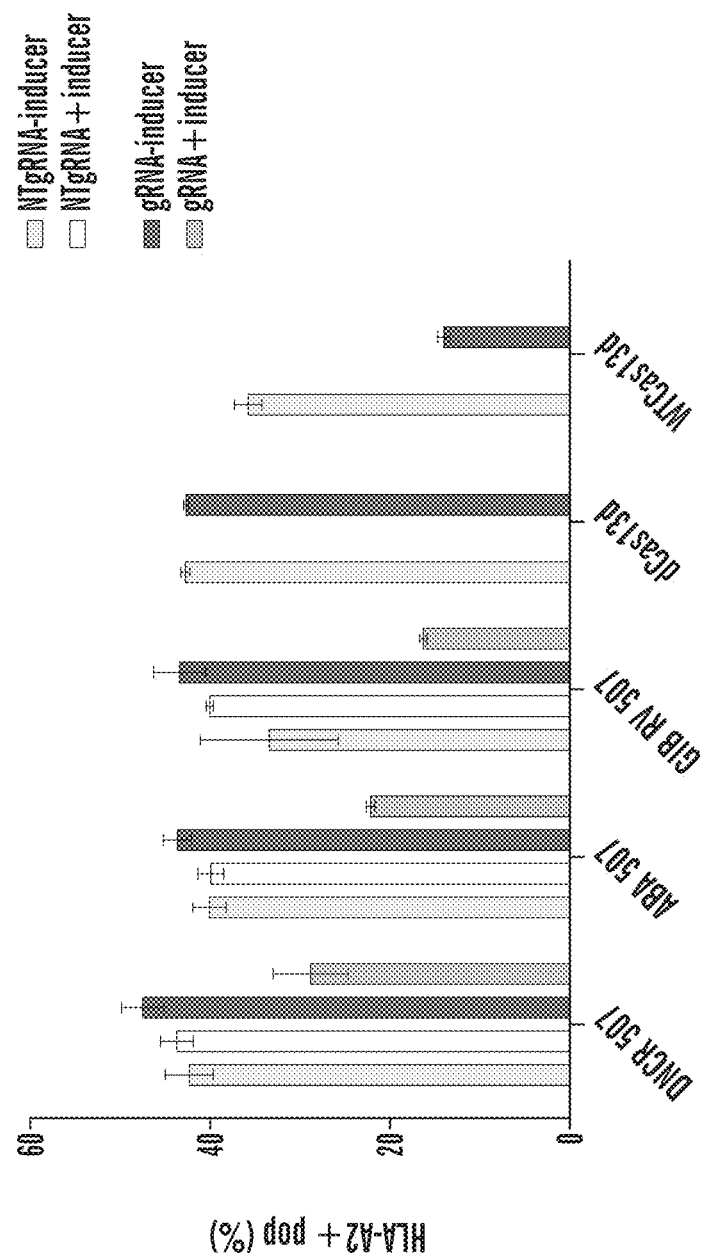
FIG. 24 is bar graph showing that inducible split RfxCas13d were able to knock down endogenous gene expression (e.g., HLA-A2). Inducible systems used from the left to the right were: the pair of N507-NS31a and DNCR-508C (protease inhibitor as the inducer; e.g., grazoprevir); the pair of N507-PYL and ABI-508C (abscisic acid as the inducer); or the pair of N507-GAI and GID-508C (gibberellin as the inducer). "dCas13d" denotes catalytically dead Cas, and "WTCas13d" denotes wild-type Cas. The left-right order of the bars for each split site is the same as the top-down order of the legend for the bar graph. "NT gRNA" indicates non-target guide RNA. It is contemplated herein that overall knockdown efficiency can be increased with optimized guide design.

The following inducible systems were also able to knock down endogenous gene expression of HLA-A2: the pair of N507-NS31a and DNCR-508C (protease inhibitor as the inducer; e.g., grazoprevir); the pair of N507-PYL and ABI-508C (abscisic acid as the inducer); or the pair of N507-GAI and GID-508C (gibberellin as the inducer); see e.g., FIG. 24.

3. Additional Designs of Inducible Split RfxCas13d to Achieve Optimal Drug Inducibility.

Select Alternative Split Sites

Figure 6B:
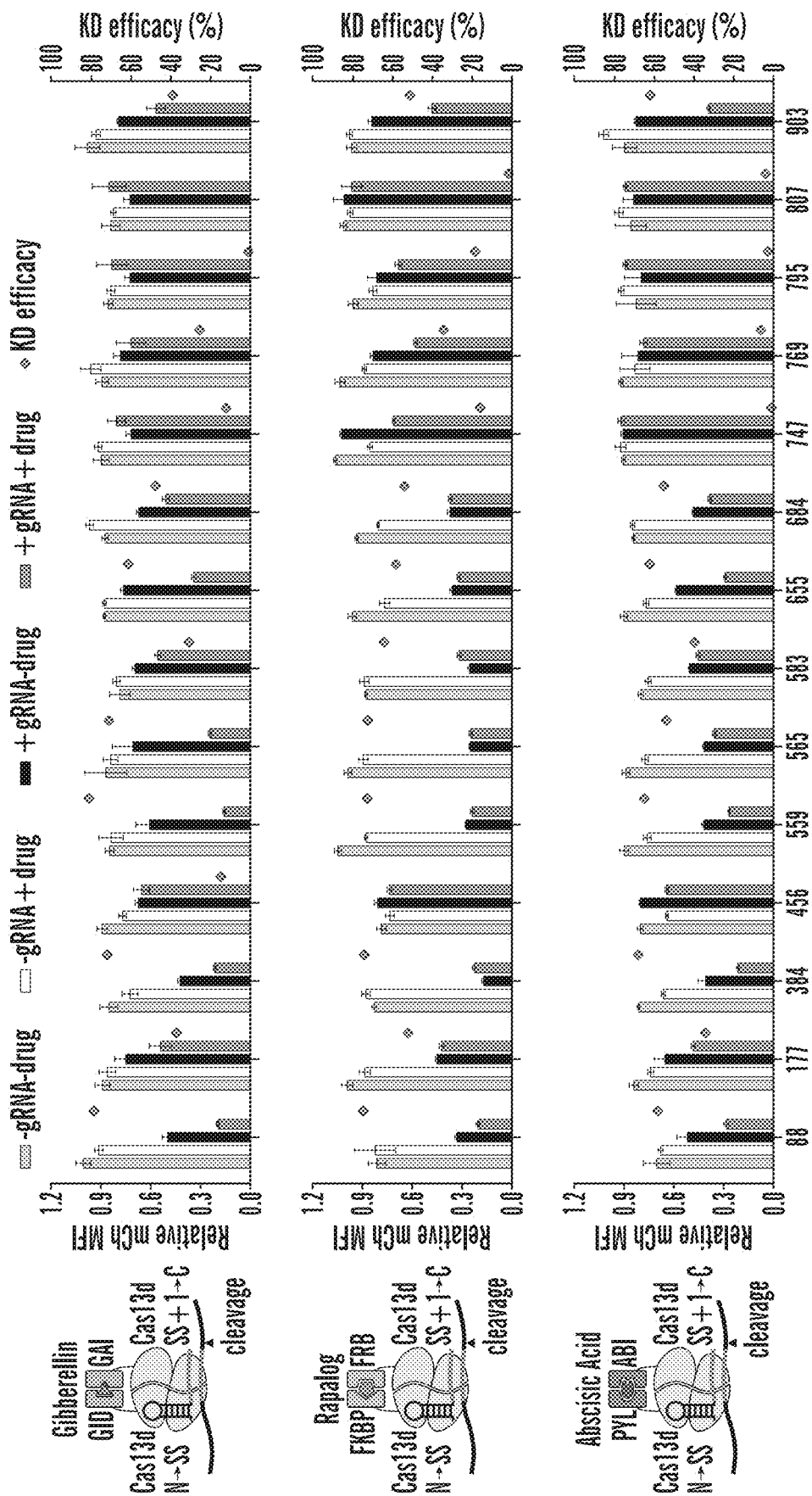
Figure 6C:
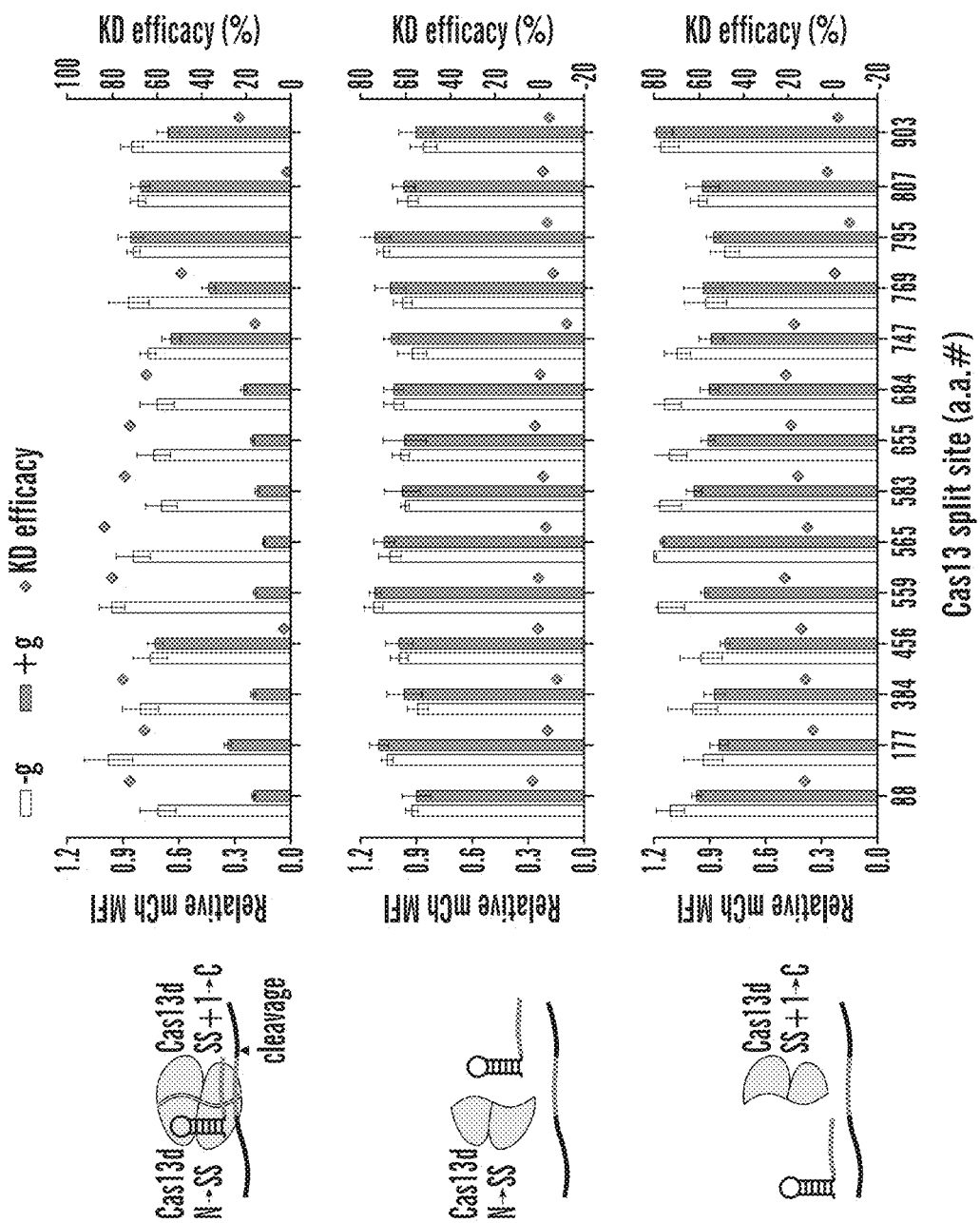

Among all split sites tested in RfxCas13d, split sites 559/560 and 565/566 were the best performing split sites with all three CIDs or without any recruitment domains (see e.g., FIG. 6B). These splits were chosen to be in the middle of a short stretch of non-conserved sequence located on the external of RfxCas13d, and the truncation of which did not result in deceased knockdown activity of RfxCas13d; see e.g., Zhang et al. (2018) supra. Similarly, sites 177/178 and 384/385 were chosen from regions that also seemed free to be eliminated in RfxCas13d, and indeed, they also demonstrated relatively efficient knockdown with assistance of gRNA. In contrast, split sites after 684/685 could not knockdown mCherry expression well with either gRNA or any inducer, except for split site 903/904. The sequence from N730 to the C-terminus constitutes the HEPN2 domain of the nuclease lobe. The HEPN2 domain contains 2 out of 4 conserved catalytic sites in Cas13d. Though of great significance, the peptide sequence of RfxCas13d in this region is not aligned well with either of the 2 Cas13d orthologs published with structural information. Thus, structure prediction in this region is not as accurate, and more split sites can be chosen and test.

Another 13 split sites have been selected throughout the sequence away from catalytic and highly conserved residues. However, while the first 14 split sites were all chosen to be in unstructured region, a few of the 13 additional split sites are in the structured regions of RfxCas13d, as the instability of the split proteins can shut down leaky knockdown activity without chemical-induced proximity. Split protein fragments can be obtained through PCR, and inserted into backbones containing dimerization domains through Gibson reactions. It is contemplated herein that split sites that demonstrate knockdown abilities can be coupled with other CID domains.

Coupling Split Cas13d's with Other CID Systems

In addition to various split sites, in order to achieve chemical inducibility of the split Cas13d, it is contemplated herein that other CIDs can be used with the split sites that achieved knockdown with at least one CID system. Comparing the same split Cas13d pair with different recruitment domains, there can be variations in both gRNA-induced and drug induced knockdown (see e.g., FIG. 6B). The use of the RAP induced dimerization domain FKBP/FRB generated similar results (−/+gRNA) as split Cas13d's without recruitment domains, while the ABA and GIB inducible systems shut down gRNA-induced knockdown to various degree, and reduced knockdown with gRNA and inducer in many split sites. Therefore, different CID systems generated varied performances with the same split Cas13d pair. In one embodiment, the CID system can be the DNCR system or GNCR system for grazoprevir or danoprevir inducible Cas13d's, respectively (see e.g., FIG. 8B). In addition to an "ON" switch, the DNCR/GNCR system can also be used to design an "OFF" switch to shut off Cas13d activity. Split Cas13d pairs can be held in close proximity using apo NS3a reader that constitutively complexes with NS3a, which can be disrupted by the addition of NS3a targeting drugs (see e.g., FIG. 9). It is contemplated herein that RfxCas13d split sites (e.g., 88/89, 177/178, 384/385, 559/560, 565/566, 583/584, 655/656, 684/685, 769/770, 903/904) can be tested with DNCR and GNCR heterodimerization domains. In-place CIDs can be digested out in a backbone containing the split Cas13d's, and PCR products of the "reader" and "receiver" proteins can be inserted into the split Cas backbone via Gibson reactions. Performances can be tested in the same manner as described above, and drug dosage of 10 uM (e.g., grazoprevir, danoprevir) can be used to induce mCherry knockdown activity in HEK293FT cells transfected with the inducible split Cas13d's with or without gRNAs. iRFP can serve as the off-target bystander gene.

Additionally, antigen-specific Cas13 activity can be achieved by targeting one split to cell membrane fused with the synthetic receptor SynNotch. Only upon recognition of its specific antigen does SynNotch receptor cleave itself on its cytosolic side and release the Cas13 split to enter the nucleus for reconstitution with its complement split Cas13

(see e.g., FIG. 23). This technology allows detection of antigens rather than artificial input signals, and it is contemplated herein that it can achieve knockdown upon detection.

Rational Optimization of the Designs

The 2 best performing designs are split 559/560 and 565/566 when they are coupled with GID CID domains. While there is only 10%-20% basal knockdown induced by gRNA, the drug-induced knockdown with gRNA is over 75% for both of them, comparable to that of wild type RfxCas13. For these 2 designs, it is contemplated herein that the N versus C terminal moiety can be compartmentalized by targeting one piece to the nucleus while retaining the other piece in the cytosol. Approaches to achieve this goal include but is not limited to the utilization of nuclear export signal (NES) and nuclear localization signal (NLS). Both have been used in split Cas9 designs to reduce basal activity induced by gRNA and the primary recruitment domains; see e.g., Zetsche et al. (2015). *Nature biotechnology*, 33(2), 139-142; Liu et al. (2016). *Nature chemical biology*, 12(11), 980-987; the contents of each of which are incorporated herein by reference in their entireties. However, the rapamycin-inducible split Cas9 demonstrated limited Indel frequency comparing to wild type Cas9, possibly due to the NES preventing a portion of Cas9 split N pieces from entering the nucleus. Without wishing to be bound by theory, the use of domains such as NES in the split Cas13 design cannot create such problem, as Cas13 is also functional in cytoplasm. Therefore, whichever compartment the split moieties unite in upon drug induction (e.g., nucleus or cytoplasm), they can both contribute to target knockdown. Without wishing to be bound by theory, by the incorporation of an NES into one split moiety, it is hypothesized that without the chemical inducer, the 2 splits can be kept at a distance from each other, and thus they can only reconstitute and function in the presence of the inducer rather than gRNAs (see e.g., FIG. 7B). In the split Cas13d construct, 2 NLSs are added onto the N and C termini of 1 split, and a relatively weak NES are used to tilt the balance so that reconstituted Cas13d's can be more readily transported to the nucleus as Cas13d's functions with higher efficiency when directed to the nucleus (see e.g., FIG. 7C); see e.g., Konermann et al. 2018, supra. Cloning and performance testing of this optimization on leaky designs can be tested in the same fashion as previously described.

Design Light Inducible Split Cas13d

Split sites that demonstrate good to moderate knockdown performance can be fused to light inducible domains, including but not limited to the blue light inducible domains such as CRY1/CIB2 and the Magnets (e.g., pMag, nMag). Systems can be transiently transfected into HEK 293 FT cells, and experimental groups can be exposed to light at the corresponding wavelength during incubation, while the control is kept from light. Knockdown activity of light inducible split Cas13d can be tested with a range of light intensities. As light induced dimerization is easily reversible, system performance can be evaluated with different lengths of light exposure, numbers of exposures, and/or time between exposures. Flow cytometry and qPCR can be used to quantify knockdown activity induced by light.

RNA Sensing Device with Cas13 Connect to Split Recombinase

As transcriptomic changes are an important process during cell development that can be transient and hard to observe, real-time imaging is often required for such purposes. However, this approach is both time-consuming and labor-intensive. Therefore, a device that recognizes transcriptomic changes and generates output with memory can assist in revealing transient changes of RNA expression in cell development. To achieve this, described herein is fusion of a split recombinase to Cas13. With 2 guide RNA targeting regions close together on a RNA transcript, Cas13's each with a split recombinase piece can be brought into close proximity, and the reconstituted recombinase can turn on its reporter expression permanently (see e.g., FIG. 25). Split Cre and Flp that generated large ON/OFF dynamic range with various inducible systems can be fused to split Cas13d's, WT Cas13d's, and other Cas13's. Without wishing to be bound by theory, fusing split recombinases to split Cas13d's can generate constitutive recombinase reporter expression. Based on data about split Cas (see e.g., FIG. 6B), split Cas13d's are able to target and knockdown target expression in the presence of gRNA, and it is likely that gRNA induced the dimerization of the Cas13d splits, which can result in constitutive recombinase activity if dimerization orientation is suitable for recombinase reconstitution. Therefore, WT Cas13d is suitable for this application. A study with the recombinase splits fused to the same version of Cas13d can be conducted. However, in this case, gRNAs targeting close regions on the target RNA could bring together the same moiety of the split recombinase, both N-terminal or both C-terminal moieties, which would compromise the overall performance of the system, and result in less efficient recombination. Thus, a system can comprise 2 different Cas13 effectors that recognizes their gRNA orthogonally. All 3 designs can be tested in conditions with and without gRNA and target RNA. Only recombinase activity in conditions with both target gene expression and targeting gRNAs indicates a functional system.

Logical Genetic Manipulation Using Cas13

Some Cas13 splits that reconstitute spontaneously can be useful when coupled with CID domains since transcriptional control of such splits allows AND gate logic. Inducible promoters are available and orthogonal systems can be used to drive split expression. As a result, there can only be target knockdown activity with input for both promoters.

Cas13 orthologs, LwaCas13a (Cas13a from *Leptotrichia wadei*) and PspCas13b (Cas13b from *Prevotella* sp. P5-125) have also been demonstrated to function with high on-target and low off-target activity in mammalian systems. To build orthogonal inducible Cas13s, it is contemplated herein that the sequence of those Cas13s can be aligned with sequence of RfxCas13d. Split sites can be chosen based on successful split sites in RfxCas13d, and split Cas13a an Cas13b fragments can be cloned in to backbones built for Cas13d. Knockdown activity can be verified with both transgenes and endogenous genes. As these Cas13 effectors require orthogonal gRNA for targeting purposes, when they are coupled with orthogonal CID domains, the entire system can be orthogonal, and multiplexed control of target knockdown can be achieved.

4. Functional Characterization of Inducible Split Cas13d

Knockdown Efficiency of Cas13d is Dependent Upon Inducer Dosage and Effector/gRNA Expression Level As demonstrated herein, varying plasmid dosages of effector Cas13d protein and gRNA both effect knockdown activity: the higher the dosage, the better the knockdown efficiency. The best-performing inducible Cas13d not only generates the best knockdown activity, but it also minimizes the leaky off-state knockdown in the +gRNA/−drug condition. Therefore, to characterize the dose dependence of the drug inducible split system and to find the optimal working condition for the inducible Cas13d system, it can be tested how the target gene knockdown correlates with both the amount of functional effector (e.g., drug concentration) and gRNA expression level (e.g., gRNA plasmid dosage). Cas13d:gRNA ratio 16:16, 8:16, 2:16, and 0.5:16 can be tested with drug concentrations across multiple orders of magnitude (see e.g., FIG. 4C-4D). It is contemplated herein that the inducible split Cas13d's that passed initial performance screening can be transiently transduced with different amount of gRNA vectors, target gene, and transfection marker. Serial dilution can be performed to make drug solutions in cell culture media so that the prepared solution can be added to transfected cell culture in a 1:4 ratio to achieve the desired final concentration at the time of induction. Cells can be collected 48 hours after induction. Flow cytometry can be used to measure fluorescent intensity of both the target and the bystander fluorescent protein.

Inducible Cas13d can Process Pre-gRNA Arrays to Target and Knockdown Multiple Endogenous Genes Simultaneously Although the inducible split Cas13d designs that "passed" the performance tests were the ones able to knock down target gene expression, other features of Cas13d can also be verified, as the disrupted protein structure in the split design could create a negative effect. As the ability of Cas13d to process pre-mature gRNA permits simultaneous multiplexed gene targeting, it is essential for the inducible split Cas13d to retain that function. Additionally, although split Cas13d's have bene proven to knockdown transgene expression, their ability to knockdown endogenous gene expression can also be explored. To achieve these goals, the compatibility of the knockdown system composed of split Cas13d's with pre-gRNAs targeting multiple endogenous genes can be demonstrated in HEK293 FT cells. Multiple guide RNAs targeting B4GALNT1, ANXA4, TP53, and STAT3 have been designed and validated to mediate targeted knockdown by WT RfxCas13d in HEK 293FT cells; see e.g., Konermann et al. 2018, supra. Mature gRNAs and pre-gRNA arrays targeting 1 to 4 of these genes can be cloned. After initial verification of the single-gene targeting gRNAs, mature and pre-mature, with the inducible split Cas13d's, it is contemplated herein that gRNAs can be selected with the best performance, and pre-gRNAs containing a gRNA array targeting from 2 to 4 genes can be cloned. Single gene knockdown efficiency achieved by the WT and inducible split Cas13d's with the multiplexed pre-gRNAs, corresponding pooled single mature gRNAs, or pooled single pre-mature gRNAs, can be compared with those by the single target pre-/mature gRNAs. Additionally, depending on the sequence in the array the gRNA is located, knockdown efficiency can vary. Therefore, another control with the gRNA in the same position in the pre-gRNA array with the other gRNAs replaced by non-targeting gRNAs can be tested; see e.g., Abudayyeh et al. (2016) supra. Gene expression level can be measured through qPCR. Knockdown efficiency can be calculated as the change in targeted gene expression (on/off) relative to the change in the expression of a transfection control. The final inducible split Cas13d design can possess both features of target cleavage and pre-gRNA process for multiplexed target gene knockdown.

Assessing Long-Term Leakiness, Induction, and Reversibility of the Inducible Split Cas13 System Besides having dose-responsive activity and the ability to process pre-gRNA array for multiplexed gene knockdown, the inducible split Cas13d system must also have minimal off-state leaky activity and can be turned on reversibly in a user-defined and timely manner. To assess these abilities, it is contemplated herein that HEK293 cells that stably expresses the inducible split Cas13d, endogenous gene-targeting gRNA, and an antibiotic resistance gene can be generated by transducing cells with lentivirus. Antibiotic selection of transduced cells can take place 2 days after transduction for up to 10 days depending on the type of antibiotic selected. Once selection finishes, cells can be induced with either a drug or vehicle control. Sustainability of the knockdown activity and leakage in vehicle control by the inducible split Cas13d can be quantified using qPCR in the beginning, middle, and the end of an induction period, and compared to controls with WT Cas13d+gRNA, WTCas13d+NT gRNA, and inducible split Cas13d+NT gRNA, and WT HEK293 cells. After the first phase of induction, media can be replaced for cells to recover from induction. The time required for cells to recover from induction can be dependent on the type of inducer and can be determined empirically as the time required for the recovery of target gene expression. Once recovered from the first induction, cells can be induced again and target gene expression can be evaluated in the beginning of the second induction (end of recovery) and the end (see e.g., FIG. 7D).

Use Inducible Cas13 to Target Circular RNAs

Circular RNA is a form of that mRNA takes on as a result of back-splicing. It can be hard to distinguish from its linear cognate using tools like short hairpin RNA. However, Cas13 has been shown to be able to distinctively target circular RNA instead of its linear version with specifically designed gRNAs. Although with initial screening facilitated by RfxCas13d, functions of some circular RNAs have been uncovered, expression of such circular RNAs may vary in different developmental stages. Therefore, an inducible system that allows temporal control of expression allows detailed functional analysis of the activity of such regulatory RNAs.

5. Drug-Responsive Endogenous Gene Knockdown by Split Cas13d in T Cells.

To demonstrate the applicability of the inducible split Cas13d, it is contemplated herein that genes in primary T cells, such as PD-1, HLA, and IL-2R, can be inducibly knocked down, as the timely control of their expression level can be the key to successful anti-cancer immunotherapy (see e.g., FIG. 7E); see e.g., Rafiq et al. (2019) Nature Reviews Clinical Oncology, 1-21, the contents of which are incorporated herein by reference in its entirety. First, expression of these genes can be verified in primary T cells, as their expression levels vary with cell states. For example, PD-1 expression is upregulated after T cell activation, and IL-2 receptor expression correlates with the amount of IL-2 in the environment. Therefore, the expression of these genes at different cell state can first be tested, and the cell condition for knockdown experiment can be determined for the optimal demonstration; the cell state during which gene expression is quiescent can serve as a control for the basal expression of genes of interest. Since all three genes are surface proteins, which is critical for their intrinsic cellular function, the effect of knockdown can be verified by surface staining with their specific antibody. Meanwhile, Cas13d activity in primary T cells can be tested. The virus in the aforementioned experiment (e.g., lentivirus comprising the split Cas13d systems) can be concentrated and transduced into primary T cells. Target gene expression under different conditions can be measured by qPCR. Once a function inducible split Cas13d system is established in primary T cells, Cas13d gRNAs targeting PD-1, HLA, and IL-2R with high specificity are designed; an automated gRNA design program can be utilized, selecting the 3-5 top-scored gRNAs targeting each gene and 1 for each gene that has great knockdown efficiency and minimum off-target effect; see e.g., Wessels et al. (2020) *Nature Biotechnology*, 1-6, the contents of which are incorporated herein by reference in its entirety. To achieve simultaneous multiplexed gene knockdown, a pre-mature gRNA array targeting all 3 genes can be built. Performance of the inducible split Cas13d can be tested against controls with non-targeting gRNAs and/or WT Cas13d's.

As the best inducible split Cas13d design generates 10-20% leaky knockdown under the gRNA only condition, such leakiness can be shut off by sequestering split pieces in different cellular compartments. However, the balance between the sequestration strength by NES and NLS and the affinity between CIDs upon induction is critical. Therefore, strength and numbers of NES and NLS can be customized for different CIDs. Titrating Cas13d expression level through varying the plasmid dose can be less accurate due to the large number of components required for the system and resource competition in vivo. Instead, the doxycycline inducible promoter can be utilized to drive Cas13d expression in a drug-dose dependent manner. To further minimize the number of components potentially hogging resources, a Cas13d split pair can be expressed using a single bicistronic vector.

Example 2

A. Determination of RfxCas13d Split Sites that Provide Induced Knockdown when Coupled with Chemical Induced Dimerization (CID) Domains.

Screening Split Sites on RfxCas13d for a Drug Induced Cas13 Mediated Knockdown System-Cas13d ON Switch.

To achieve spatiotemporal control of the knockdown activity, described herein are small chemical inducible RfxCas13's with the careful selection of split sites in the RfxCas13d effector protein. Screening was done with the design of On-switches, where knockdown activity is turned on in the presence of drugs which recruitments dimerization of the CID domains attached to complimentary split Cas13 moieties.

The secondary structure of an analogous Cas13d ortholog, EsCas13d (*Eubacterium siraeum* Cas13d), was used to predict the structure of RfxCas13d through HHPred alignment. Split sites were selected to avoid conserved residues among Cas13d orthologs, secondary structures, and catalytic domains. In addition, as the cleavage activity of Cas13 effector requires the dimerization of the 2 catalytic domains, most split sites were selected to be in between these catalytic domains so that either terminal moieties would not have constitutive RNA cleavage capability on their own (see e.g., FIG. 8B). Moreover, some deletions on the external surface of the effector protein do not result in adverse effect on Cas13d cleavage activity; see e.g., Zhang et al 2018, supra. Therefore, split sites within these regions should not disturb critical structures for the functionality of Cas13d (see e.g., FIG. 8B). Split fragments were obtained through polymerase chain reaction (PCR) and dropped into backbones with CID domains: the gibberellin (GIB), abscisic acid (ABA), or RAP (rapalog) inducible systems, or heterodimerization domains inducible by the FDA approved drug for Hepatitis C: Grazoprevir (GRZ) or its analog Danoprevir (Dano); see e.g., Weinberg et al. 2019, supra; Foight et al. 2019, supra. The final cloning products in screening for each design were 2 constructs, where the N-terminal Cas13 fragment was fused with GID, ABI, FRB, or NS31a domains on the C-terminal end, and the C-terminal Cas13 fragment was fused to GAI, PYL, FKBP, GNCR, or DNCR domains on its N-terminal end. Paired constructs were transiently transfected into HEK 293 FT cells for screening, with mCherry, the targeted transcript, targeting/non-targeting gRNAs, and the transfection marker, iRFP. Controls where only the N-terminal or C-terminal constructs, instead of in pairs, were transfected to determine if any constitutive activity was retained by any split moiety. All gene expression was driven by CAG promoter except for gRNAs which was under control of U6 promoters. Media with 5× inducer or vehicle control was added 2 hours after PEI transfection for a final drug concentration of 1× or none. Cells were collected and flow cytometry measurements were taken 48 hours after induction. System performance was quantified as shown in FIG. 8A. Split Cas13d pairs coupled with GIB CID domains generated the best induced performance; ABA and Dano CIDs achieved inducibility, and RAP CIDs lead to high leaky knockdown induced by gRNA (see e.g., FIG. 8B). Moreover, split Cas13d's 88/89, 263/364, 507/508, 559/560, 565/566, and 655/656 were able to generate consistently strong drug-induced knockdown across various CID systems (see e.g., FIG. 8B). Of the plain split Cas13 moieties (no CID attached) tested, splits that achieved knockdown with CID domains all showed constitutive activity in presence of gRNA; basal leakiness is a widely existing problem across drug induced designs (see e.g., FIG. 8C). Without the help of any CID domains, these split pairs also achieved gRNA induced target knockdown with efficiency up to 80% (see e.g., FIG. 8C). In addition, results showed that no N or C terminal moiety by itself (i.e., without its corresponding C or N terminal moiety) with or without recruitment domains achieved significant knockdown of target gene; even split sites chosen so that one moiety included both catalytic domains of Cas13d (e.g., split 89C, 178C, or N903) did not lead to target knockdown without the help of their complementary moieties (see e.g., FIG. 8C).

Screening Split Sites on RfxCas13d for a Drug Inhibited Knockdown System-Cas13 OFF Switch.

Linking split Cas13d's to the dNS3 and ANR domains that constitutively bind to each other, it is contemplated herein that the system can have constitutive knockdown activity. When inducer Danoprevir/Grazoprevir is added, the system can be led to separation by dNS3 and ANR so the knockdown activity is halted (see e.g., FIG. 9). After screening split sites that generated inducibility as ON switches, it was found that Danoprevir and Grazoprevir were both able to inhibit the constitutive knockdown activity. However, in the presence of the inhibitor, target gene (mCherry) expression was not the same as in the non-targeted conditions, indicating the system was not being shut off completely by inducers. Among all splits tested, knockdown activity by split pair 559/560, 565/566, and 507/508 were well inhibited, and target gene expressed in the presence of inducer was only down regulated by less than 40%, while the constitutive knockdown was over 70%. The reversed orientation was also tested where dNS3 was attached to the C terminal split and ANR was attached to the N terminal split, but that did not show better activity than the original orientation. These OFF switches can be optimized through changing linker properties and regulating moiety compartmentalization (e.g., NES, NLS, and/or ERT domains).

B. Optimization Off Functional Inducible Split Cas13d Designs

Figure 10A:
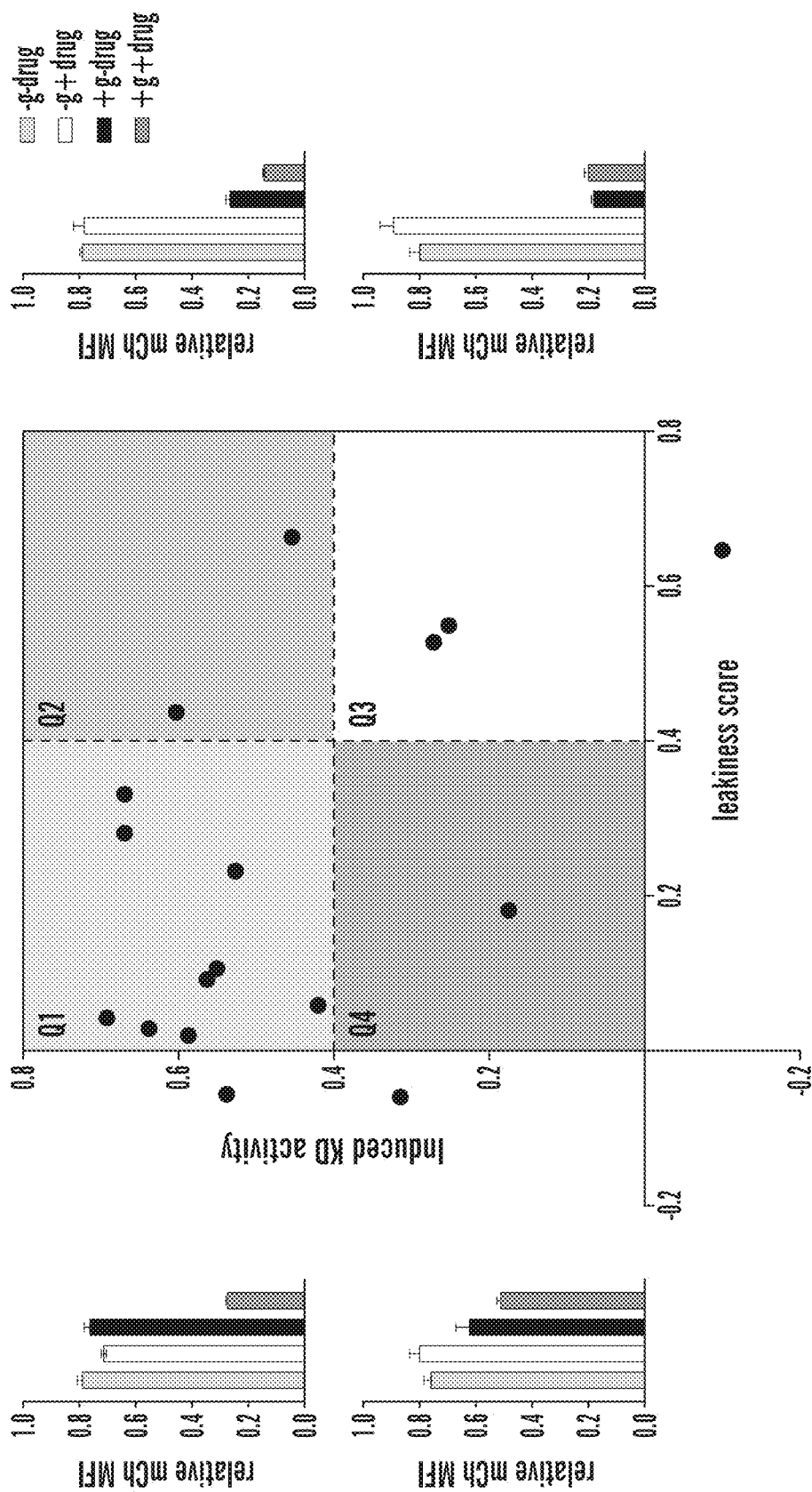
FIG. 10A-10B is a series of schematics and graphs showing performance optimization through separating split Cas13d moieties in different cellular compartments.
Figure 10B:
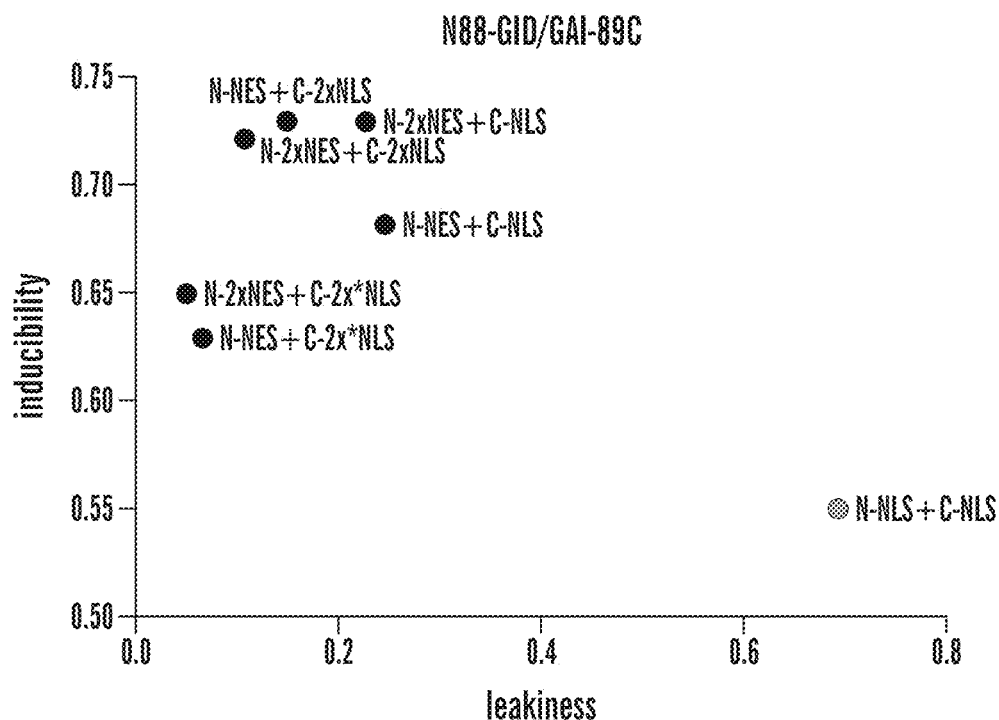
Figure 10B:
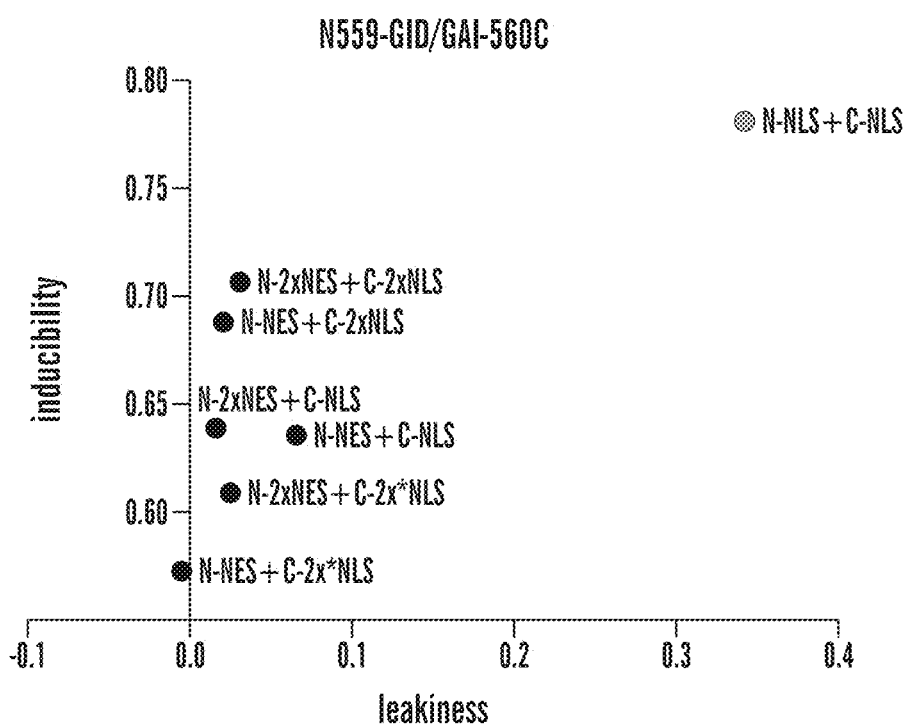
Figure 10B:
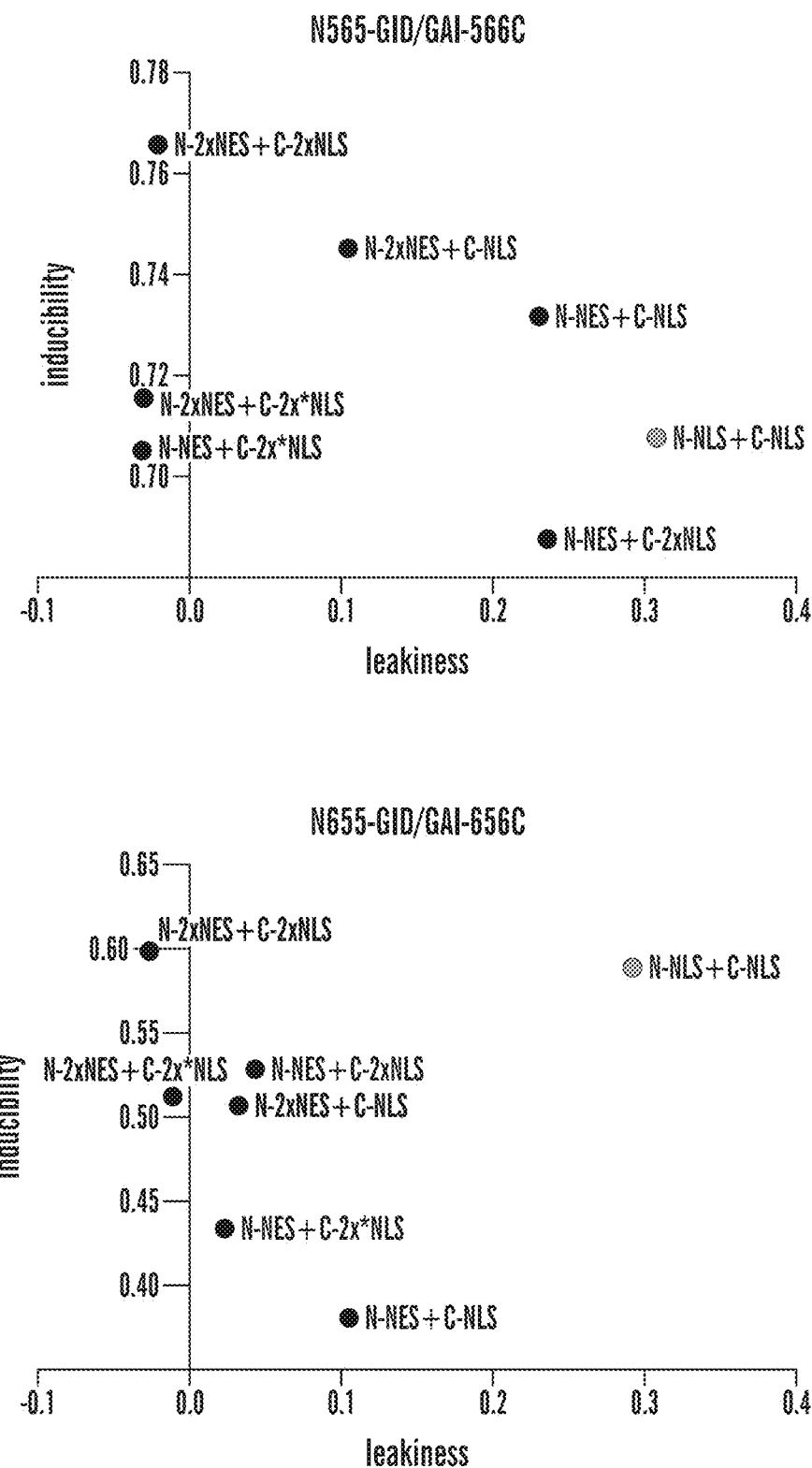

The screen of the 27 splits sites in Cas13d with various CID domains produced a library of inducible systems; however, some split constructs demonstrated uncontrolled leaky knockdown (e.g., knockdown without gRNA or drug inducer, or knockdown with gRNA but without drug inducer). However, a useful inducible split Cas13 system with applications in either research or clinical settings needs to have its activity tightly regulated. Therefore, the designs can be optimized. To stay consistent in the evaluation and for a better visualization of the performance of the systems, induced knockdown activity was plotted against leakiness score (see e.g., FIG. 10A). The plot was divided into quadrants: Q1 contains systems with minimal leakiness and strong induced knockdown (the optimal performance of the system); Q2 contains systems with strongest leakiness and inducibility; systems with both high leakiness score and inducibility are in Q3; Q4 contains system with little activity. A valid optimization moves system performance towards the upper (improved inducibility), left (reduced leakiness), or upper-left directions.

Reducing Inducer-Independent Leaky Activity by Regulating the Localization of Split Moieties Across Cellular Compartments.

After screening 27 split sites with different CID systems, there was leaky knockdown activity in absence of inducer among the split Cas13 designs (see e.g., FIG. 8B). To eliminate this leakiness, the 2 split moieties were separated in different cellular compartments to minimize contact between them under uninduced conditions. Instead of attaching one SV40 nuclear localization signal (NLS) to each split moiety, these designs have 1 or 2 of nuclear exporting (NES) signal sequence with different strength attached to one moiety, and 1 or 2 NLS sequence attached to the other moiety (see e.g., FIG. 10A). Originally leaky GIB induced Cas13 split pairs 88/89, 559/560, 565/566, and 655/656 were successfully optimized and achieved high inducibility with minimal leakiness (see e.g., FIG. 10C). The design with 2 NESs on the N terminal moieties and 2 NLSs on the C terminal moieties consistently generated the best performance for all 4 GIB-induced Cas13 splits. The same design on Danoprevir-inducible Cas13d split 559/560 also eliminated the inducer independent leakiness while maintaining over 60% induced knockdown. However, attaching 1 or 2 NES or NLS on one moiety in a complementary pair did not increase inducibility while reducing leakiness.

It should be noted that NLS and NES cannot strictly sequester polypeptides in a cellular compartment. NLS and NES shift the balance between the shuttling between nucleus and cytosol. It is contemplated herein that where both split pieces with NLS, both with NES, with neither NLS nor NES, or one with/without NES/NLS, the presence of a gRNA can allow the splits to come into close proximity with each other and bind to be active. The degree of activeness can be variable in these settings.

Determining the Orientation of the Dimerization Domains with Respect to Split Cas13 Moieties.

Figure 11:
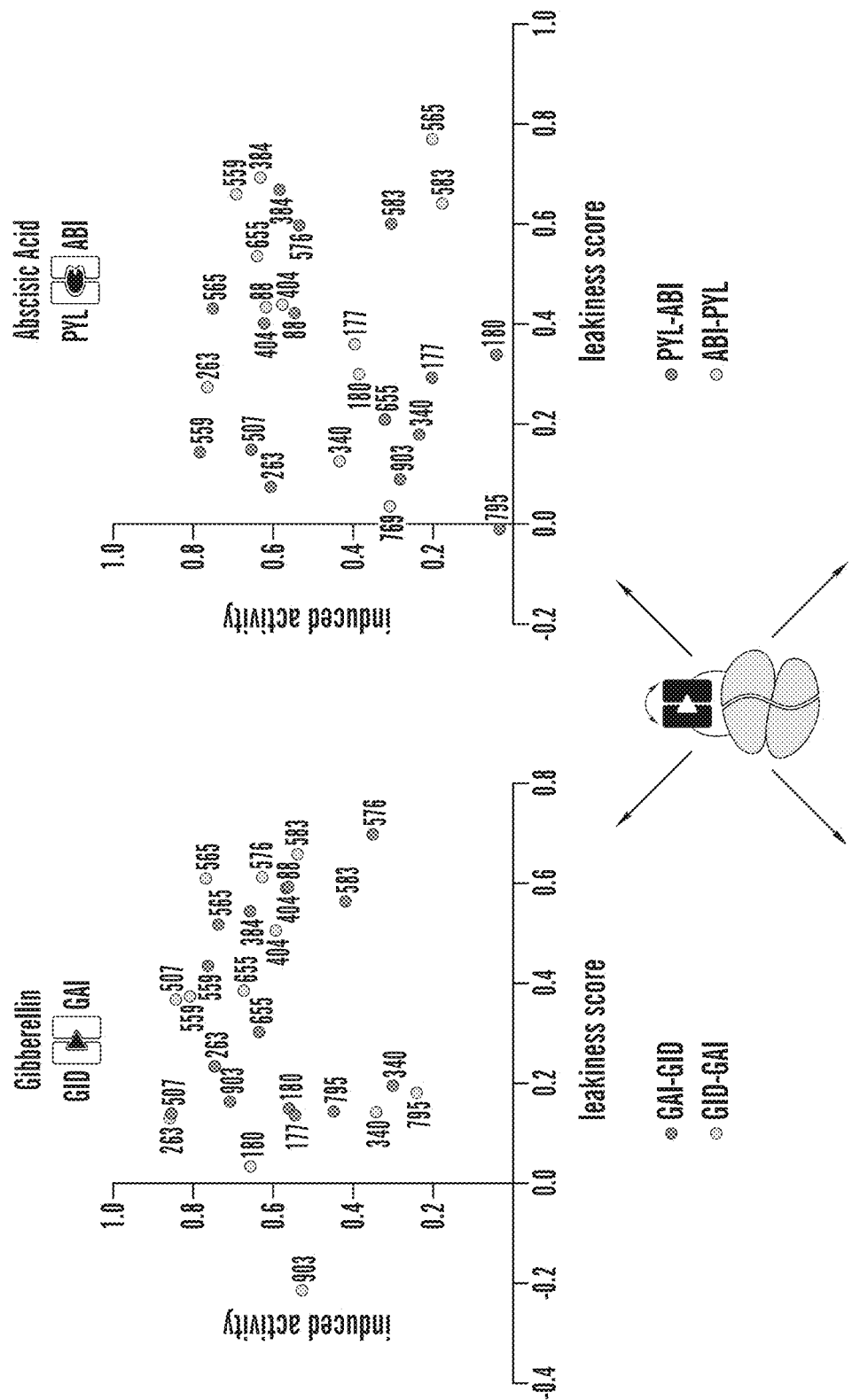
FIG. 11 is a series of schematics and graphs showing the testing of reversed orientation (dark grey dots) of CID domains with respect to split Cas13d pieces against original orientations (light grey dots) designed for GIB, ABA, Dano, and GRZ inducible systems.
Figure 11:
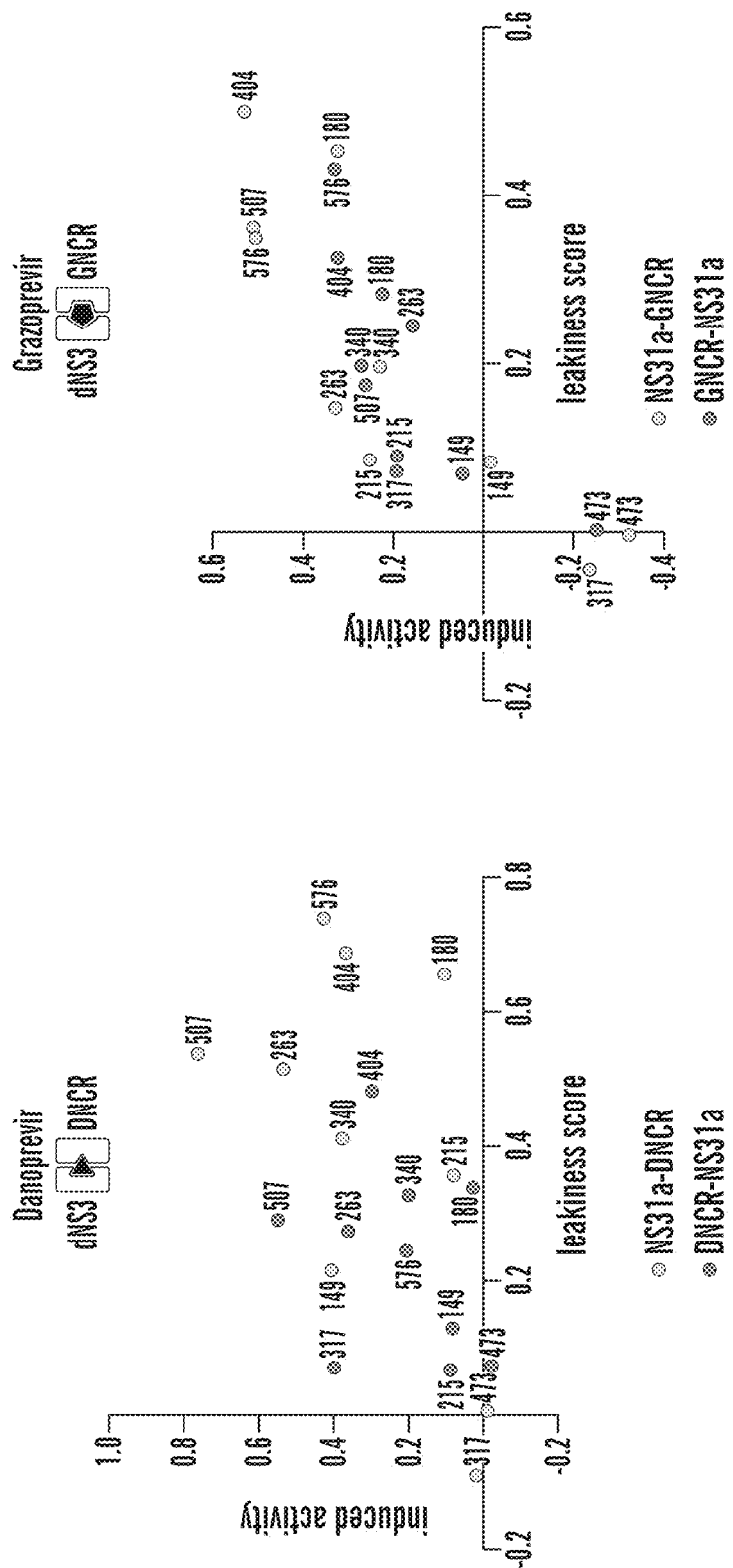

In screening experiments for the best split location of Cas13, one orientation of the heterodimerization domains against split Cas13 moieties was tested for each CID system. For example, the GIB inducible split Cas13s were designed so that the GID domain is attached to the C terminus of the N terminal split piece, and the GAI domain attached to the N terminus of the C terminal piece (N ss-GID/GAI-ss C). In this section, a different orientation of the heterodimerization domains were tested, compared, and contrasted with the original design. In FIG. 11, the light grey points represent original orientation (N ss-GID/GAI-ss C), and dark grey represents the reversed orientation tested (N ss-GAI/GID-ss C). For the GIB inducible system, there was no consistent difference between designs with the 2 orientations across split sites. Split pair 507/508 with the orientation N507-GAI/GID-508C showed superior performance compared to the original design (N507-GID/GAI-508C). Similarly, with the ABA inducible system, split 559/560, 507/508, 263/264, and 565/566 all showed stronger inducibility and weaker leakiness with the reversed orientation, N ss-PYL/ABI-ss C. For the danoprevir and grazoprevir inducible systems, a set of split sites was tested, and the majority of designs with dNS3 domains on the C terminal Cas13 moieties were consistently located in the $4^{th}$ quadrant with minimal activity. Therefore, the orientation N ss-dNS3/DNCR-ss C (or N ss-dNS3/GNCR-ss C) was chosen for additional studies.

C. 4-Hydroxytamoxifen (4-OHT) Inducible Split Cas13d

As many split Cas13 pairs were able to be constitutively recruited by gRNA and perform knockdown activity, and the physical separation of split pieces have facilitated the reduction of leaky activity in chemical induced Cas13 systems, also described herein is a tamoxifen-inducible split Cas13 system. ERT2 domain attached onto a Cas13 split moiety can be used to regulate its location; when tamoxifen is added, this ERT2 moiety is transferred inside the nucleus so it is able to meet its complementary split moiety that was constitutively directed to the nucleus; the reconstituted Cas13 then performs knockdown upon gRNA expression.

For the creation of 4-OHT inducible split Cas13d, the split sites screened in FIG. 8B were tested to knockdown mCherry fluorescence. There was an orientation preference where ERT2 on the N-terminus of split Cas13d resulted in no knockdown activity, meanwhile an ERT2 domain on the C-terminus of split Cas13d showed inducibility with the orientation shown in FIG. 12A. The other split piece of Cas13d does not have an ERT2 domain and localizes to the nucleus. The two pieces reconstitute with the addition of 4-OHT to turn on knockdown activity once the cytoplasmic piece is transported into the nucleus.

Figures 12A, 12B:
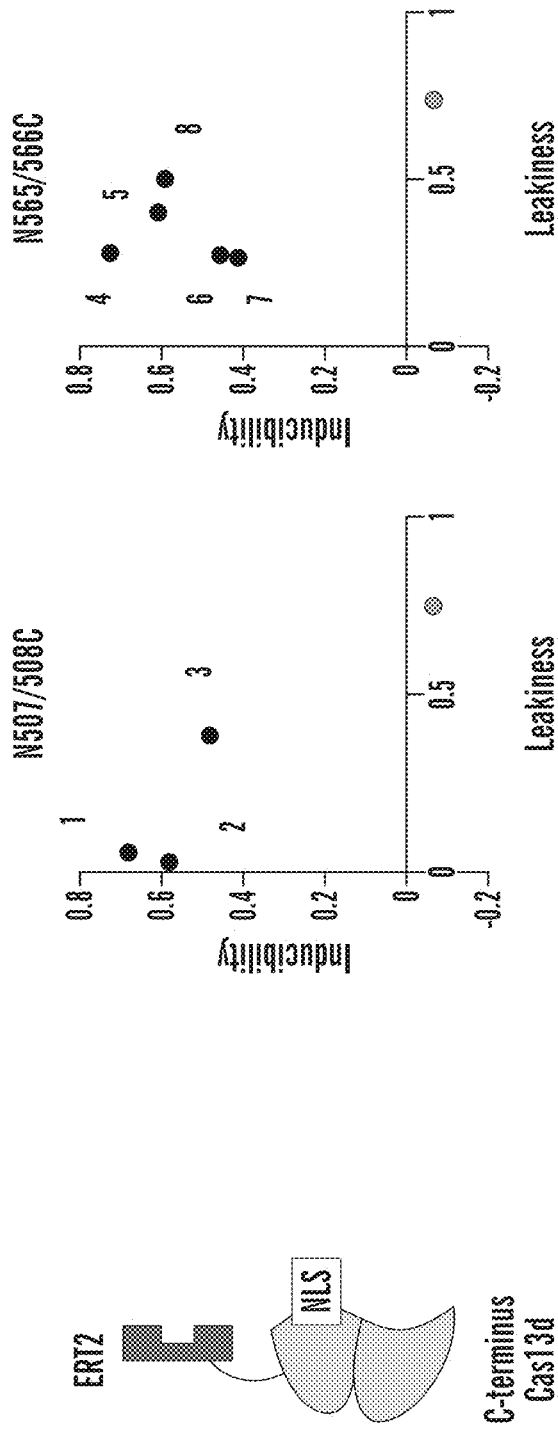
FIG. 12A-12C is a series of schematics and graphs showing optimization of 4-OHT inducible RfxCas13d.
Figure 12C:
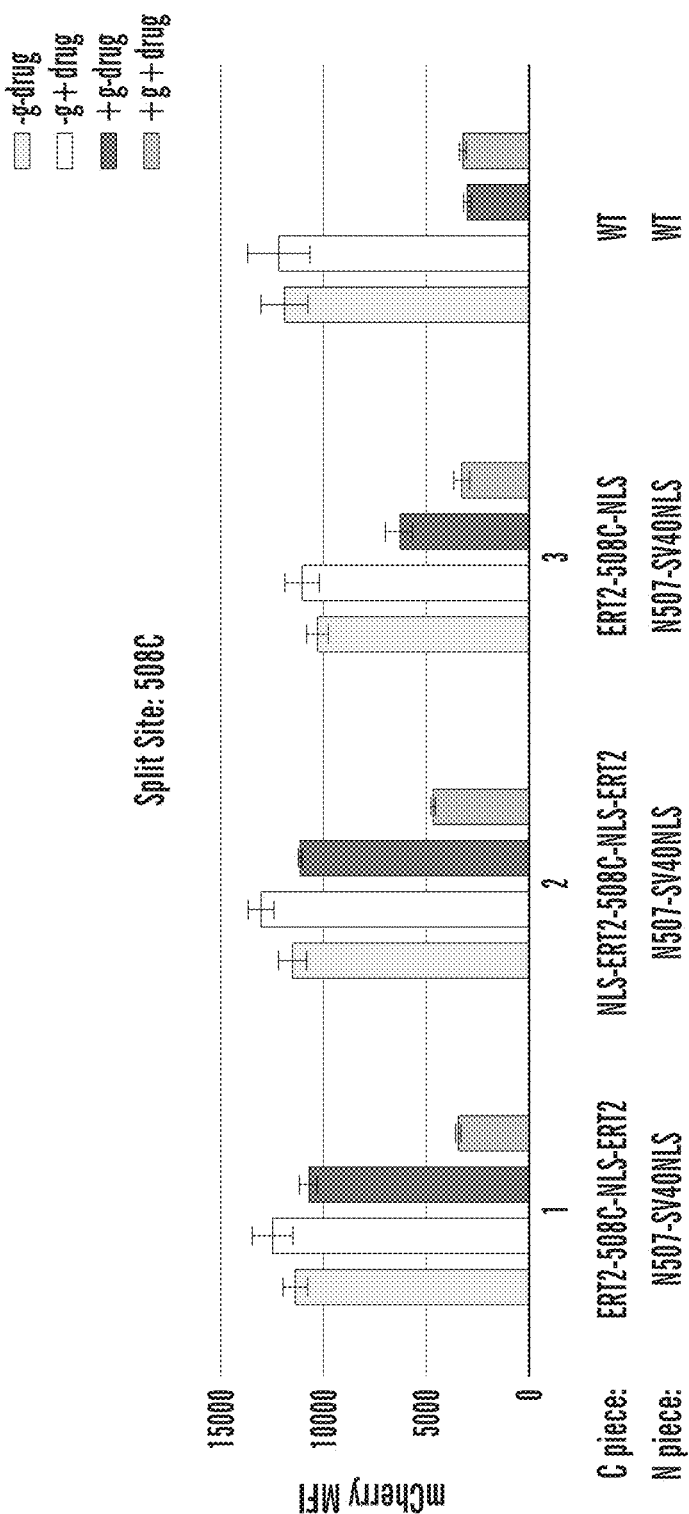
Figure 12C:
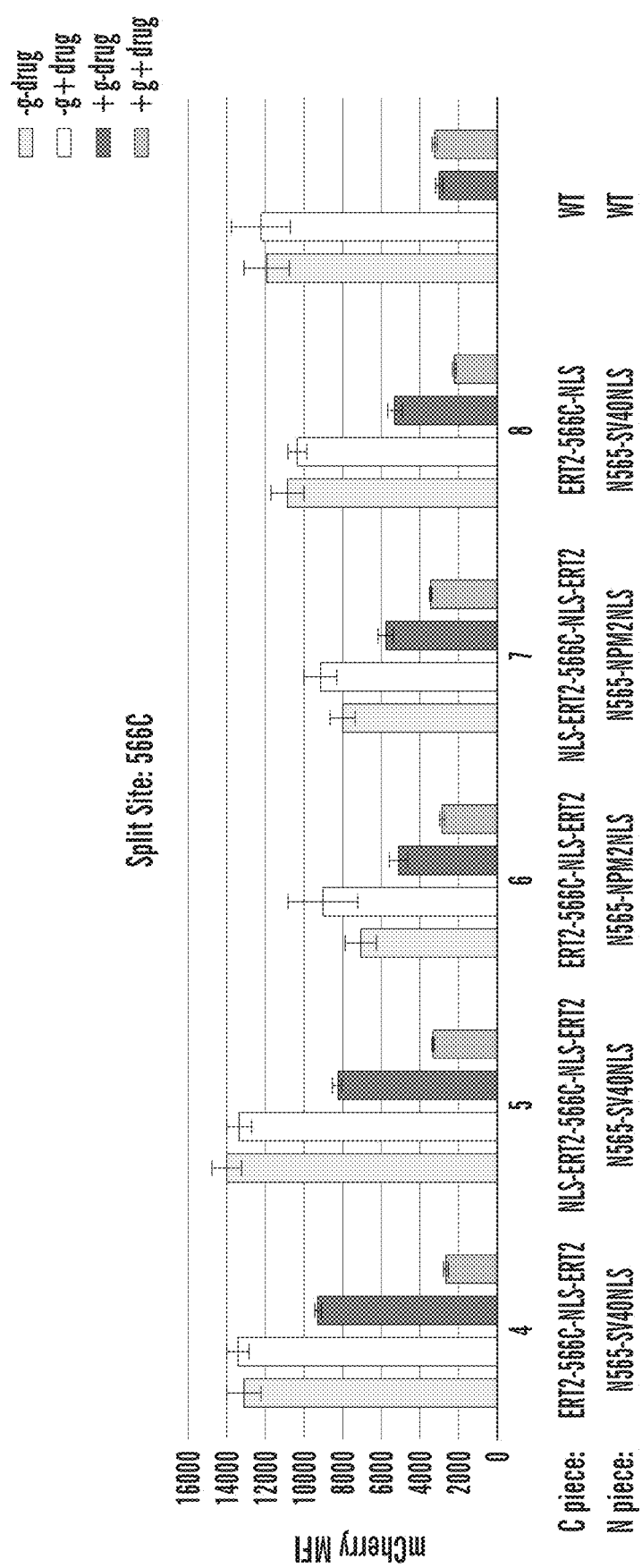
Figure 14A:
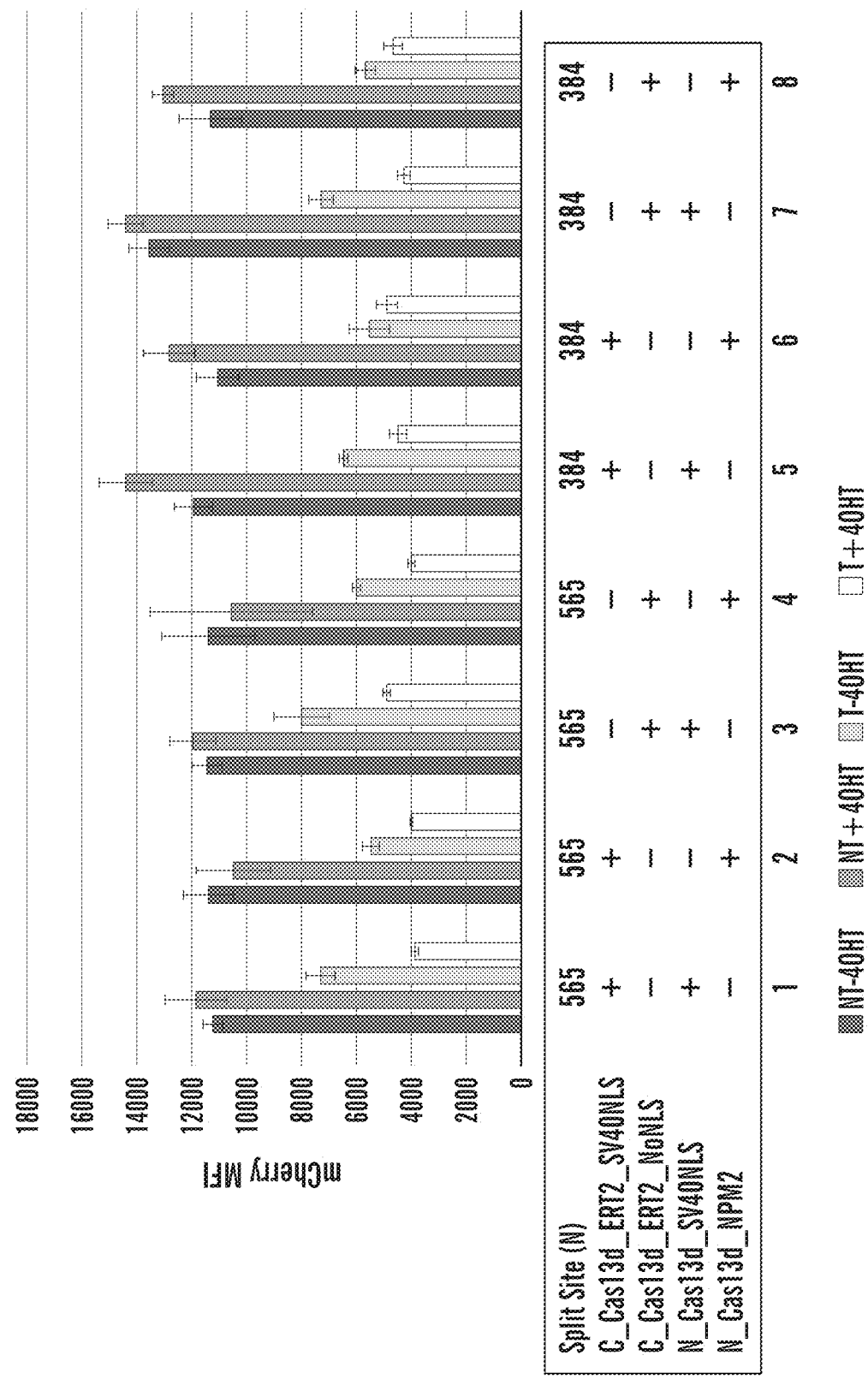
FIG. 14A-14B is a series of graphs showing a comparison of Cas13d_ERT2 with or without an NLS.
Figure 14B:
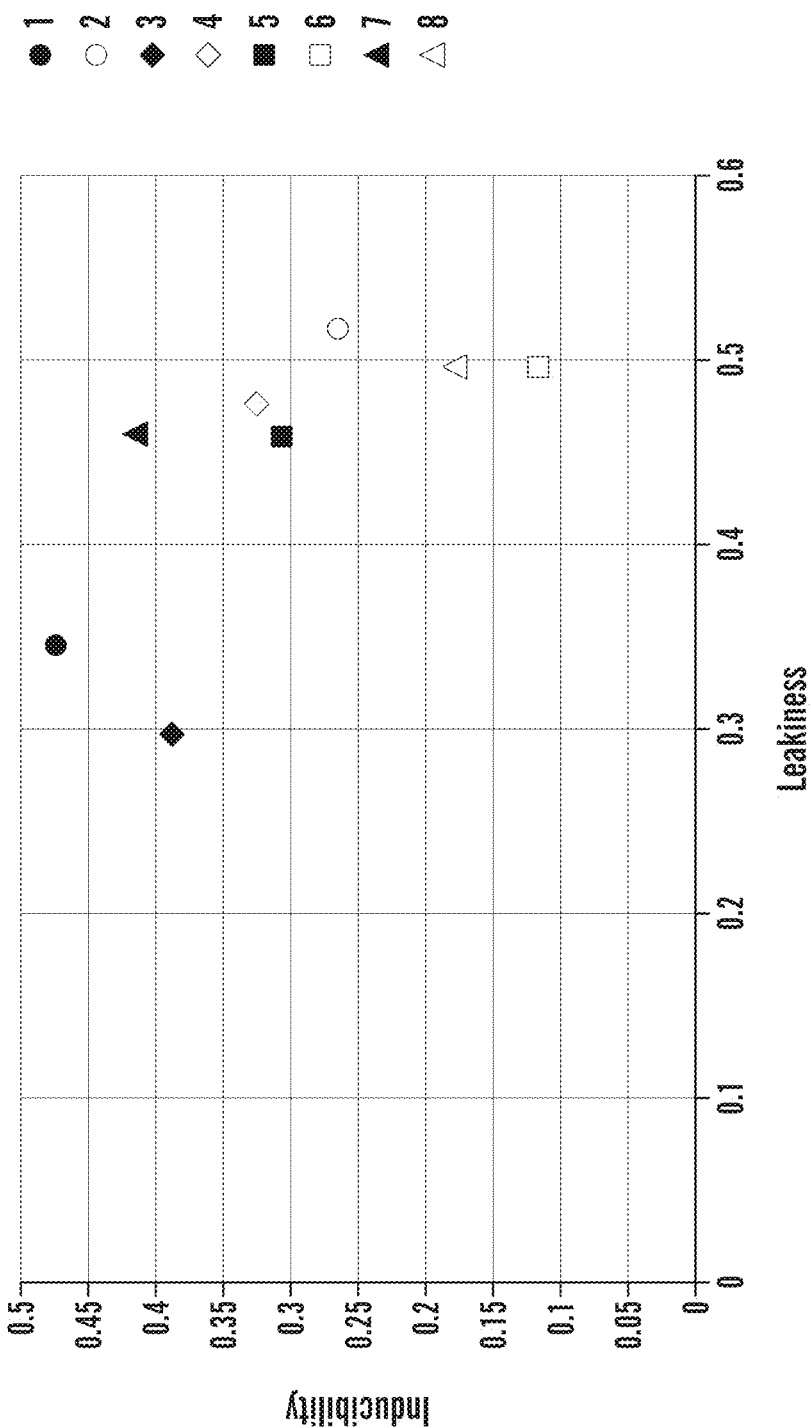
Figure 15A:
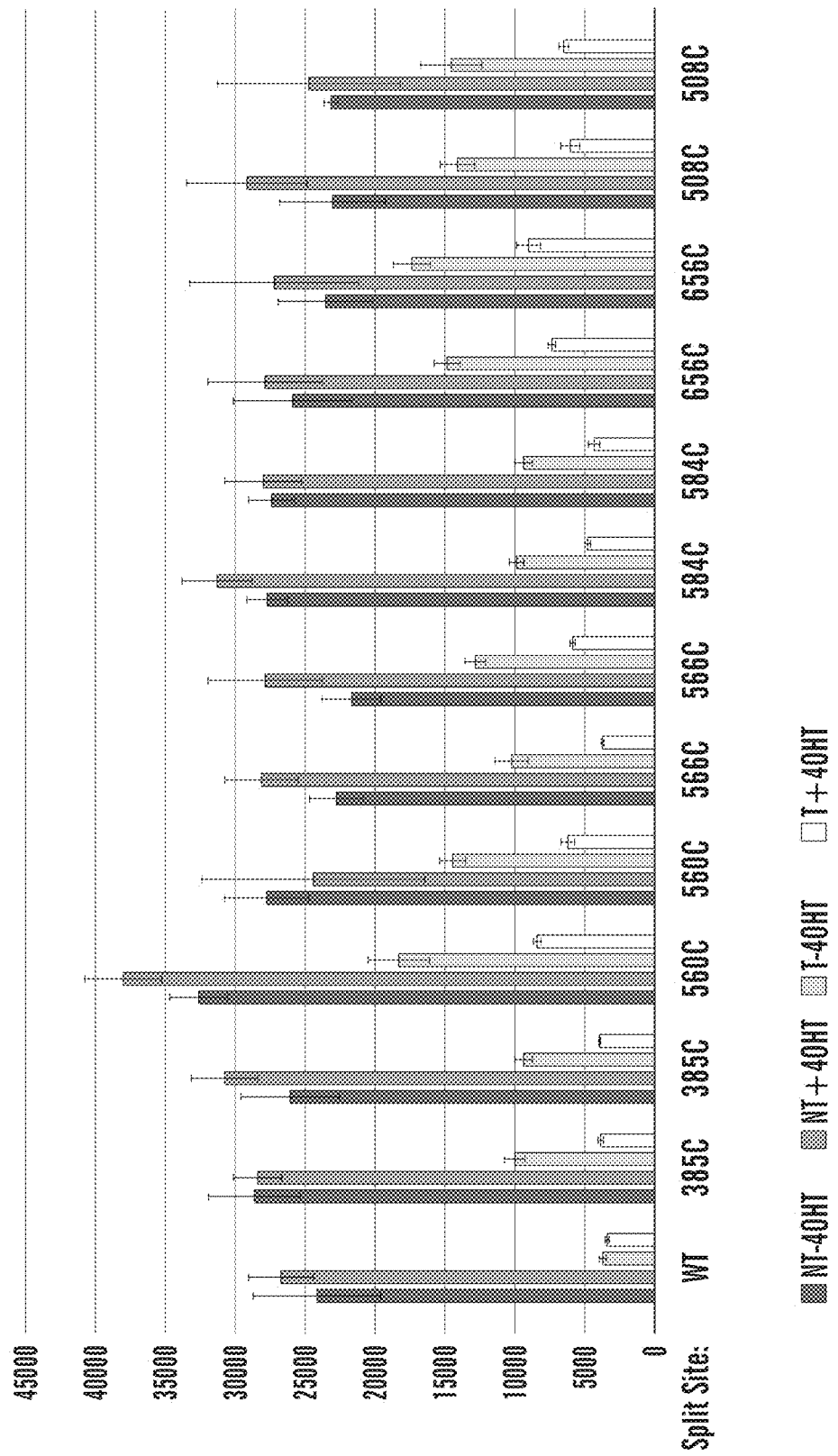
FIG. 15A-15B is a series of graphs showing a comparison of Cas13d_ERT2 with or without an NLS.
Figure 15B:
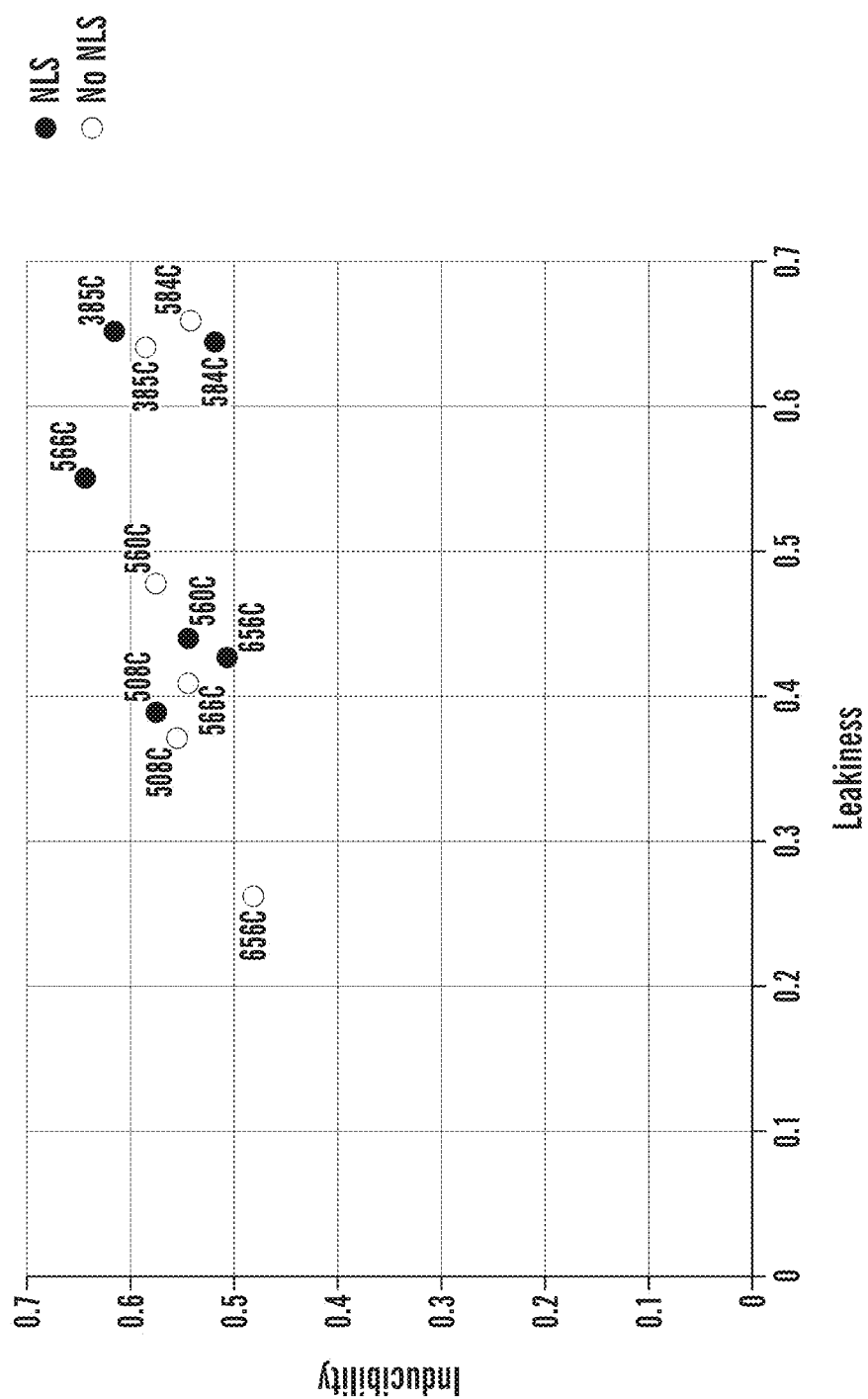
Figure 16:
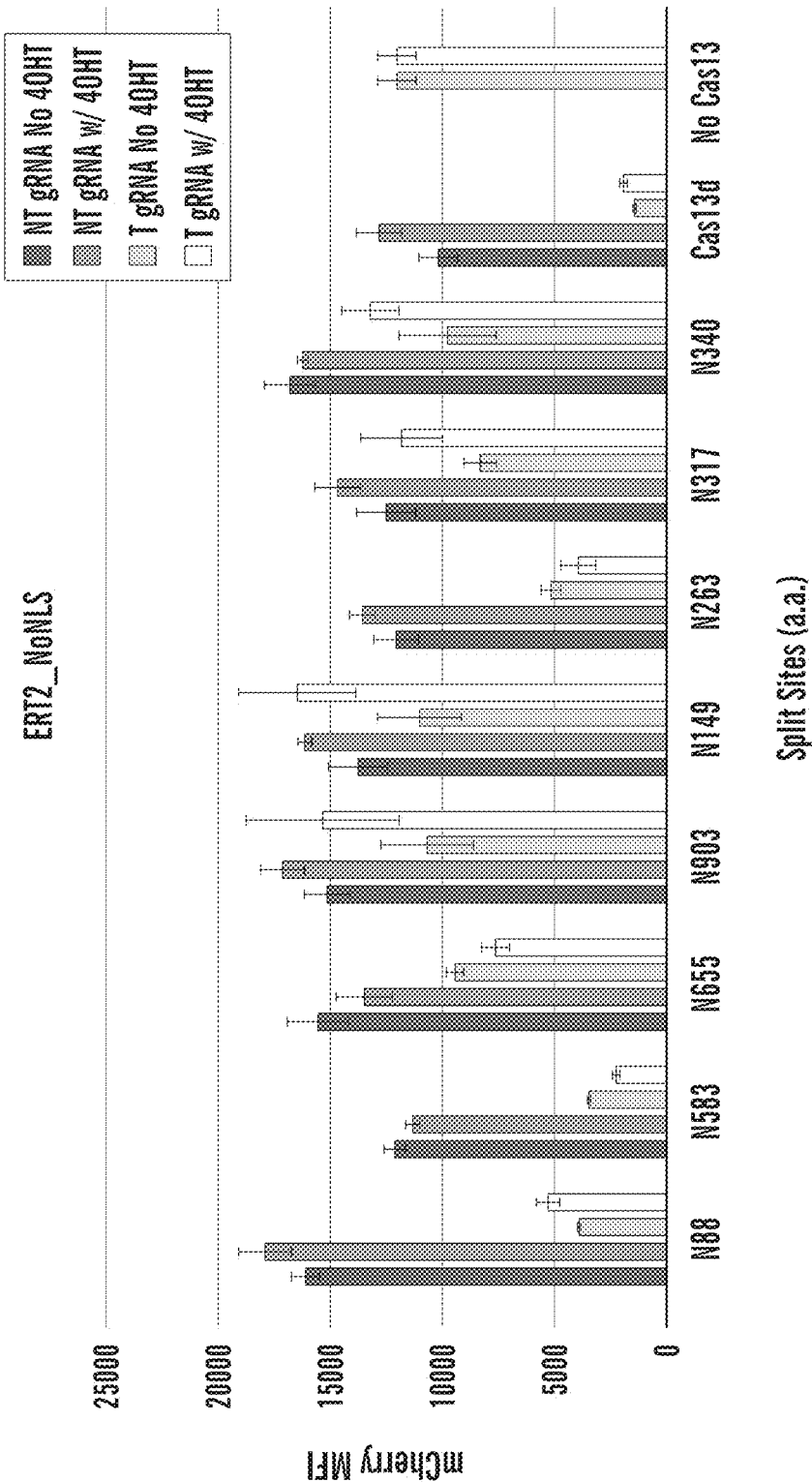
FIG. 16 is a bar graph showing that when the ERT2 domain is on the N-split Cas13d piece, inducibility was much lower compared to the design with ERT2 on the C pieces shown in FIG. 14A-14B and FIG. 15A-15B. The left-right order of the bars for each split site is the same as the top-down order of the legend for the bar graph.
Figure 17:
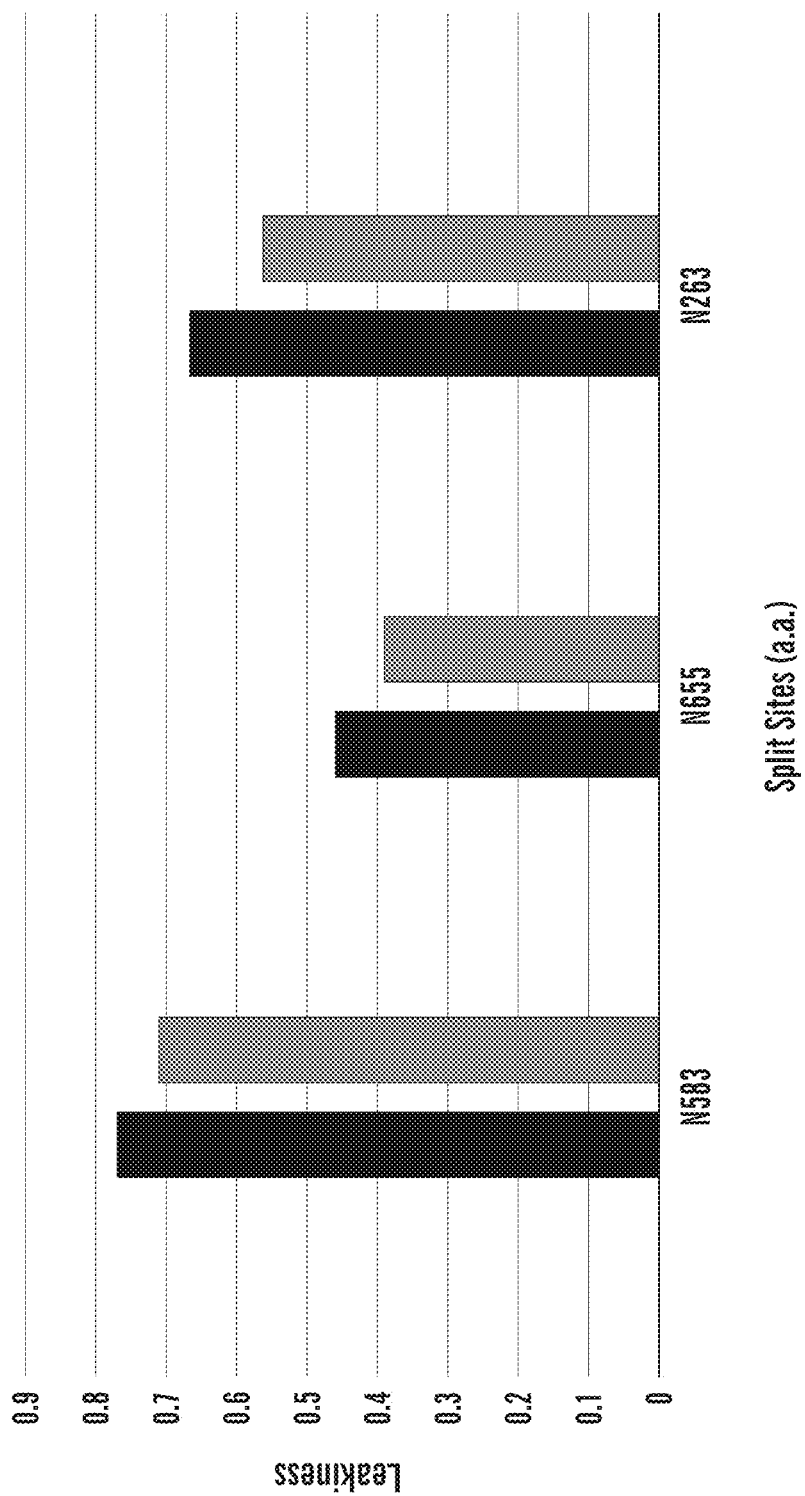
FIG. 17 is a bar graph showing the testing of leakiness among N-split Cas13d sites with and without an NLS; removal of the NLS did not have a significant impact. The left-right order of the bars for each split site is the same as the left-right order of the legend for the bar graph.

The design is based off previous chemical inducible domain constructs (described above) and was further optimized to reduce leakiness and improve inducibility (see e.g., FIG. 12B and FIG. 12C). To improve inducibility another ERT2 domain was added to the end of the original construct, which had the ERT2 before the C-terminus split Cas13d piece. To reduce leakiness, NLS domains were removed from the segment with ERT2; however, the leakiness did not improve (see e.g., FIG. 15A-15B, FIG. 16-17). While it has been reported that that adding 2 NLS's resulted in superior knockdown, herein one NLS had better knockdown activity than the two; see e.g., Liu et al. (2016) Nature Chemical Biology, 12, 980-987; the content of which is incorporated herein by reference in its entirety. Additionally, a more effective NLS (NPM2) was added to the N-split Cas13d piece; however, leakiness was not significantly improved and inducibility went further down (see e.g., FIG. 14A-14B). The NLS after the 566C split Cas13d piece can be replaced with an NES to improve leakiness and inducibility.

D. Logical Genetic Manipulation Using Cas13

Although the propensity of many Cas13 splits to reconstitute spontaneously has led to leaky knockdown activity when coupled with CID systems, transcriptional control of such splits creates an AND gate logic. Inducible promoters (IP) such as WNT, NFkB, CAGA12, and AP1 promoters are available to orthogonally drive split Cas13 expression. In such design, there can only be target knockdown activity when there is input for both promoters. After verification for the ability of these promoters to inducibly drive gene expression using fluorescent proteins (see e.g., FIG. 13E), experiments were conducted with split RfxCas13d pieces and WT RfxCas13d. The chosen split was 559/560 as this split pair is able to achieve target knockdown efficiency more than 80%, and its knockdown ability surpasses that of WT RfxCas13d when coupled with the GIB CID system.

Figure 13B:
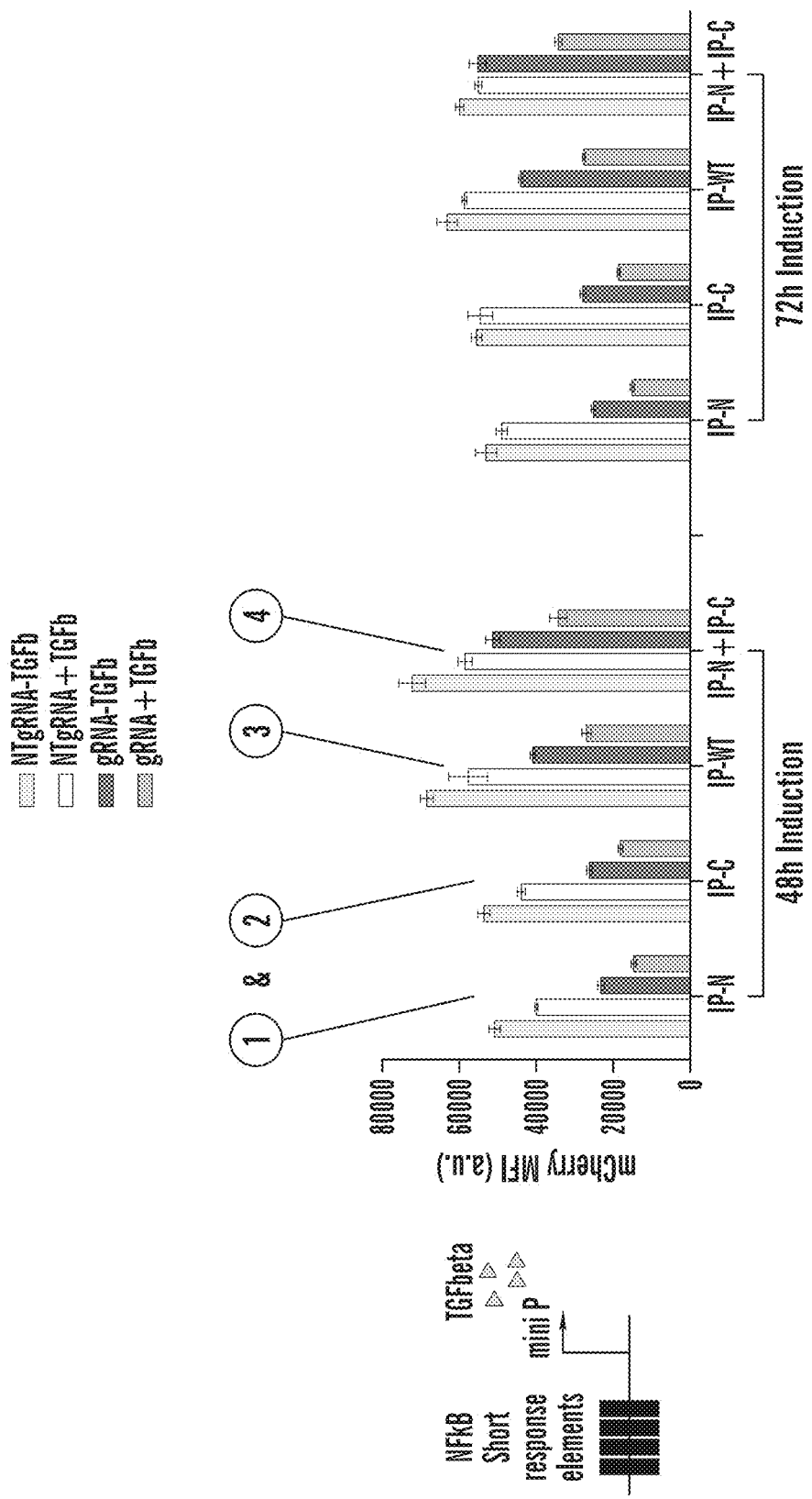
Figure 13C:
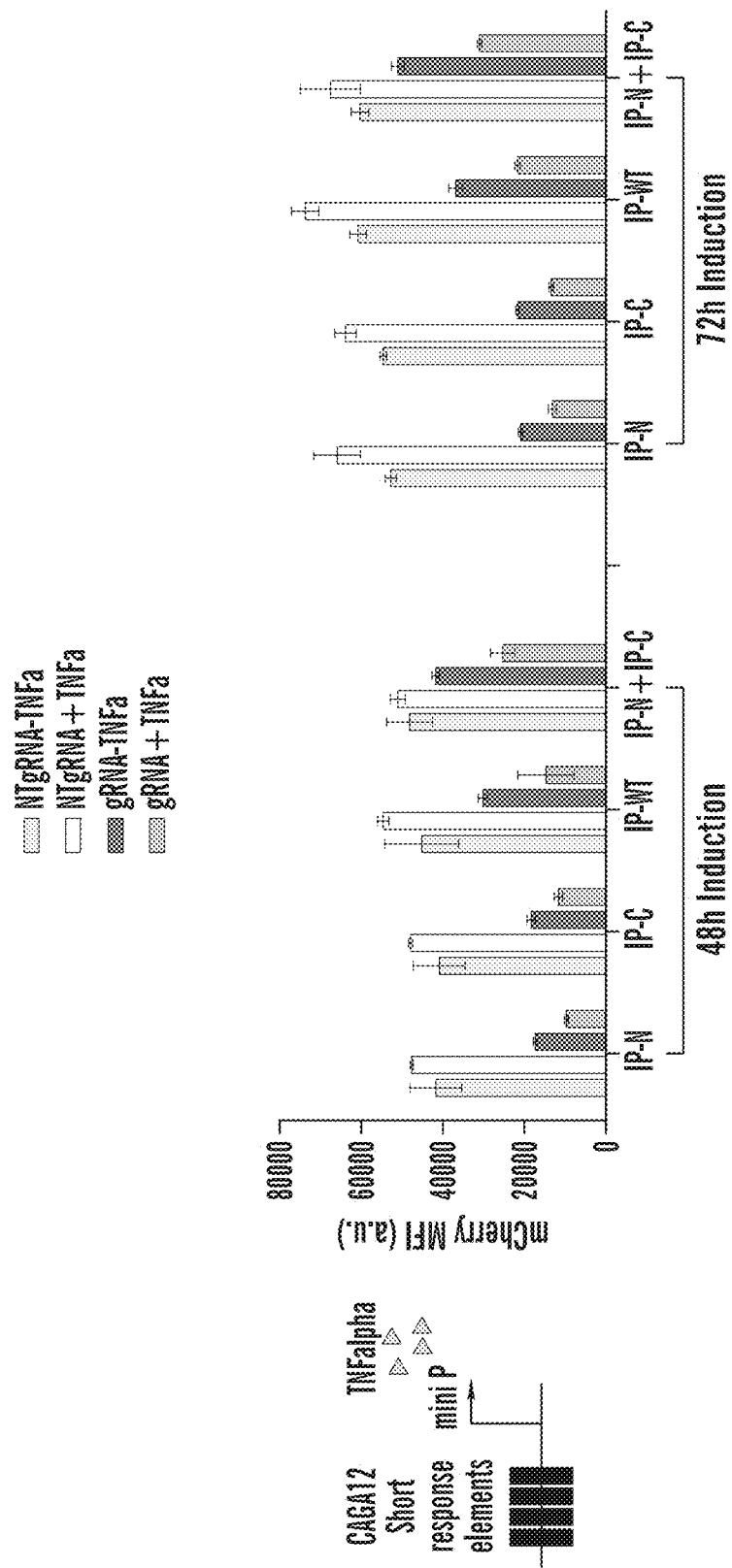
Figure 13D:
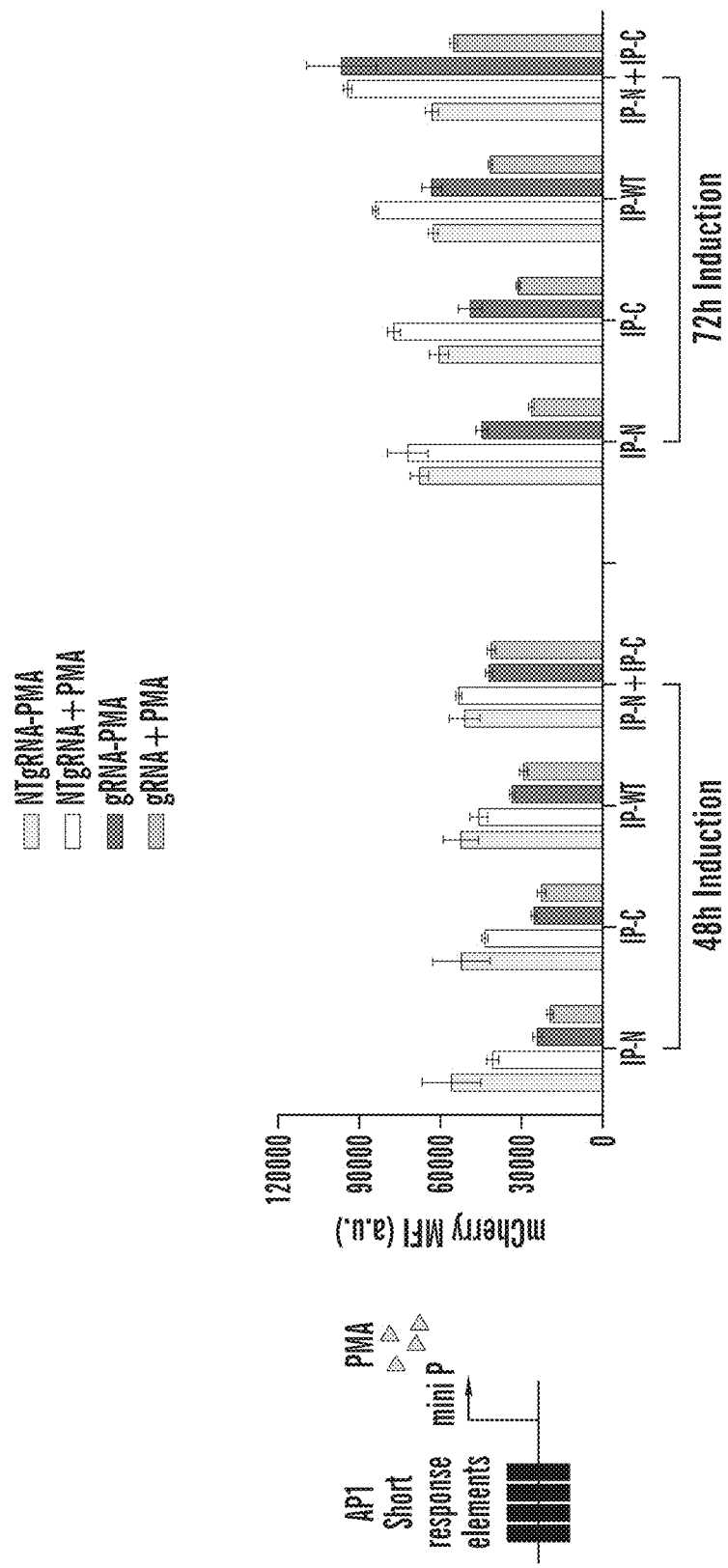
Figure 13E:
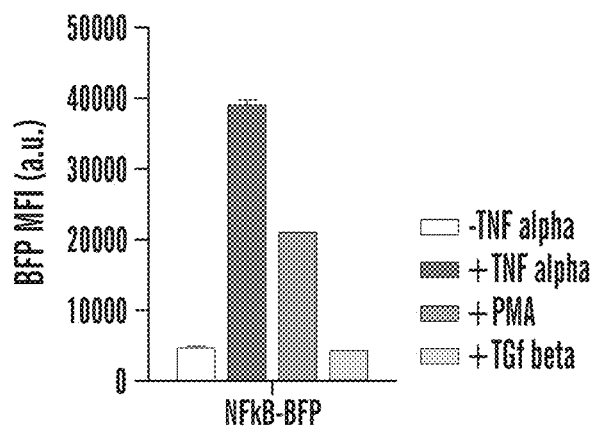
Figure 13E:
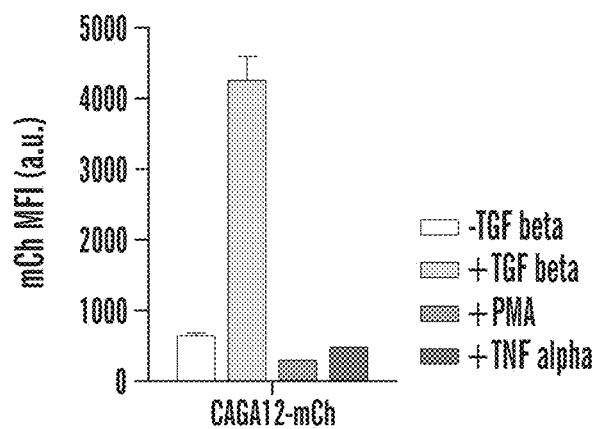
Figure 13E:
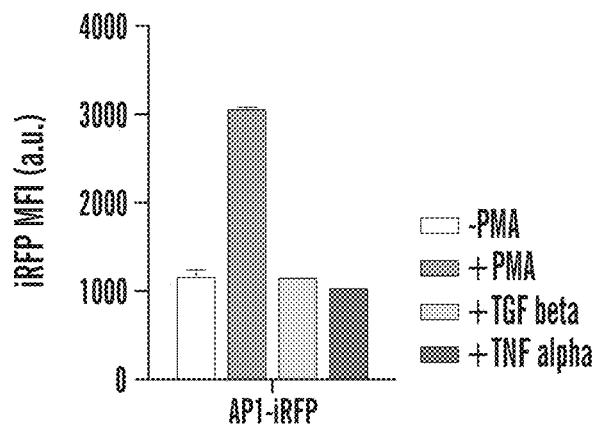

Inducible promoter driving the WT Cas13 serves as the positive control (see e.g., FIG. 13A middle panel; see e.g., setting 3 in FIG. 13B, corresponding to "IP-WT" in FIG. 13B-13D). The highest inducibility among the 3 IPs was 30% inducibility with the promoter CAGA12. All 3 IPs tested showed strong leaky knockdown in the uninduced condition. In some experiments, groups were also included where one Cas13 split piece is driven by an IP while its complementary piece is driven by a strong CAG promoter (see e.g., FIG. 13A left panel; see e.g., settings 1 and 2 in FIG. 13B, corresponding to "IP-N" and "IP-C," respectively, in FIG. 13B-13D). Overexpressing one piece of the split Cre (e.g., using the CAG promoter) in such a setting can demonstrate if any piece plays a more dominant role or is expressed at a different level from each other. Based on the results for all 3 IPs, no one piece in the 559/560 pair was dominant, and both pieces were expressed at similar level. Moreover, this setting also served as a positive control of the overall knockdown efficiency for any logic gates that can be constructed using one of the 3 tested IPs with another a second IP (e.g., selected from the 3 tested IPs or another IP as known in the art) since no known inducible promoter is as strong as CAG promoters. In addition, overall knockdown in these 2 settings (e.g., IP-N and IP-C) was more efficient than IP driving WT Cas13's, indicating that expression was a more dominant factor for efficient knockdown than dimerization of split Cas13d's. Finally, a group was transfected with 2 plasmids carrying the same IPs, each driving one of 2 split pieces (see e.g., FIG. 13A right panel; see e.g., setting 4 in FIG. 13B, corresponding to "IP-N+IP-C" in FIG. 13B-13D). Compared to setting 1 or 2, setting 4 showed weaker overall knockdown (non-target (NT) gRNA vs induced gRNA), with consistent inducibility and reduced leakiness, which is likely due to the lower expression level of both pieces. In order to use these IPs to construct an AND gate, orthogonality was also tested among the 3 IPs tested herein. NFkB was turned on by PMA (inducer for AP1 promoter), while the other promoters were specific to their own inducer (see e.g., FIG. 13E). Integrating constructs with these IPs into the AAVS1 sites provides better ON vs OFF dynamic range. As such, the aforementioned constructs (e.g., split recombinase and IPs) can be integrated into AAVS1 sites and their performance evaluated.

Coupling Split Cas13d's with Other Chemical Inducible Systems

Comparing the same split Cas13d pair with different recruitment domains, there were variations in both gRNA-induced and drug-induced knockdown. The use of the RAP-induced dimerization domain FKBP/FRB generated similar results (−/+gRNA) as split Cas13d's without recruitment domains. The ABA and GIB inducible systems shut down gRNA-induced knockdown to various degrees, and there was reduced knockdown with gRNA and inducer in many split sites. Therefore, different CID systems generated varied performances with the same split Cas13d pair. In addition to the disclosed CID systems, the split Cas13 platform can be tested with additional chemical inducible systems.

Antigen specific Cas13 activity can be achieved by targeting one split to cell membrane by fusing it with the synthetic receptor SynNotch; only upon recognition of its specific antigen, the SynNotch receptor cleaves itself on its cytosolic side and releases the Cas13 split to enter the nucleus for reconstitution with its complement split moiety (see e.g., FIG. 23). This technology allows detection of antigens rather than artificial input signals, and it is contemplated herein that it can achieve knockdown upon detection.

E. Light Inducible Split Cas13d

Figure 18:
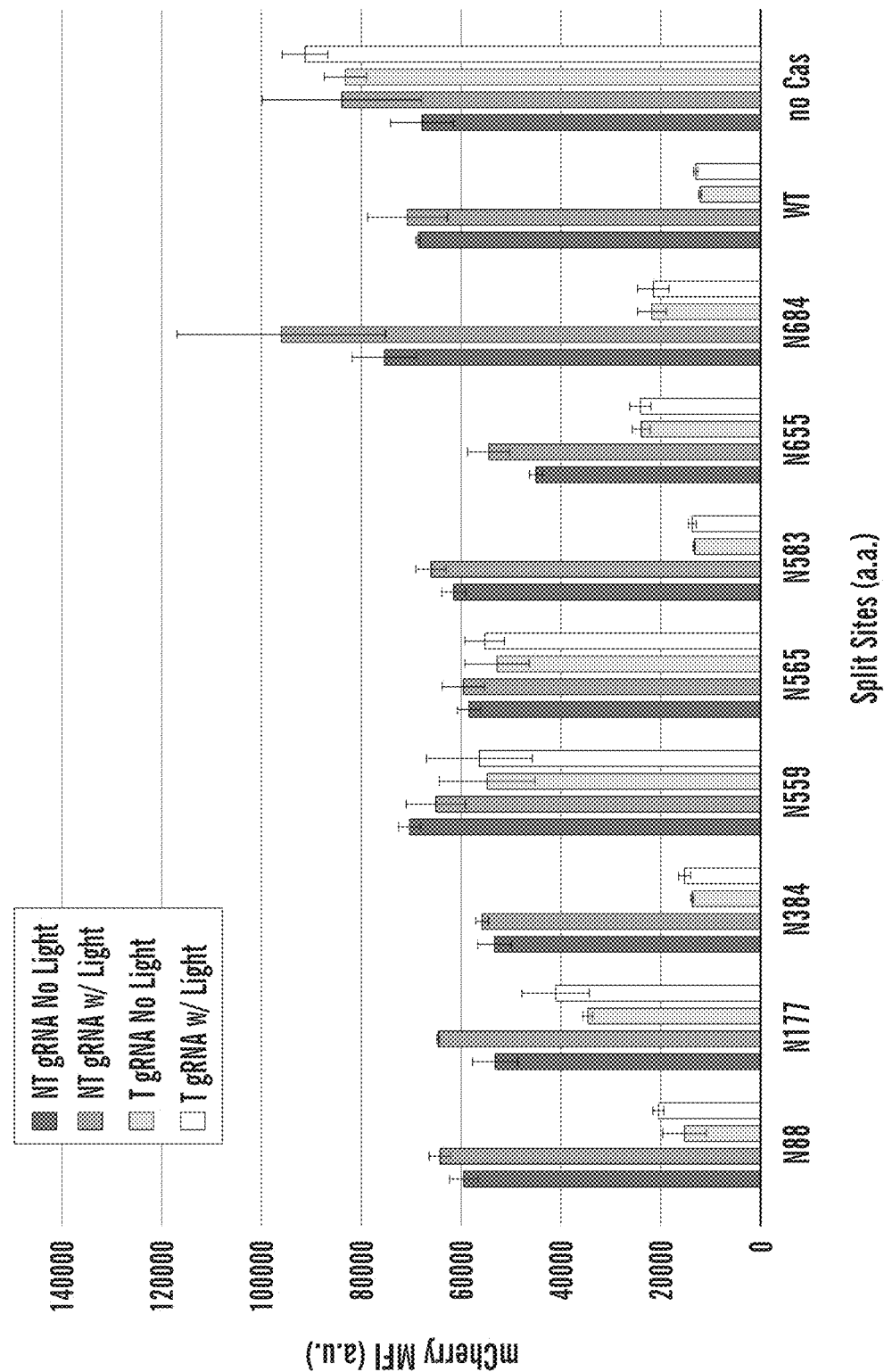
FIG. 18 is a bar graph showing that there was little inducibility when Pmag is on the C-terminus and Nmag is on the N-terminus of Cas13d splits. The left-right order of the bars for each split site is the same as the top-down order of the legend for the bar graph.
Figure 19:
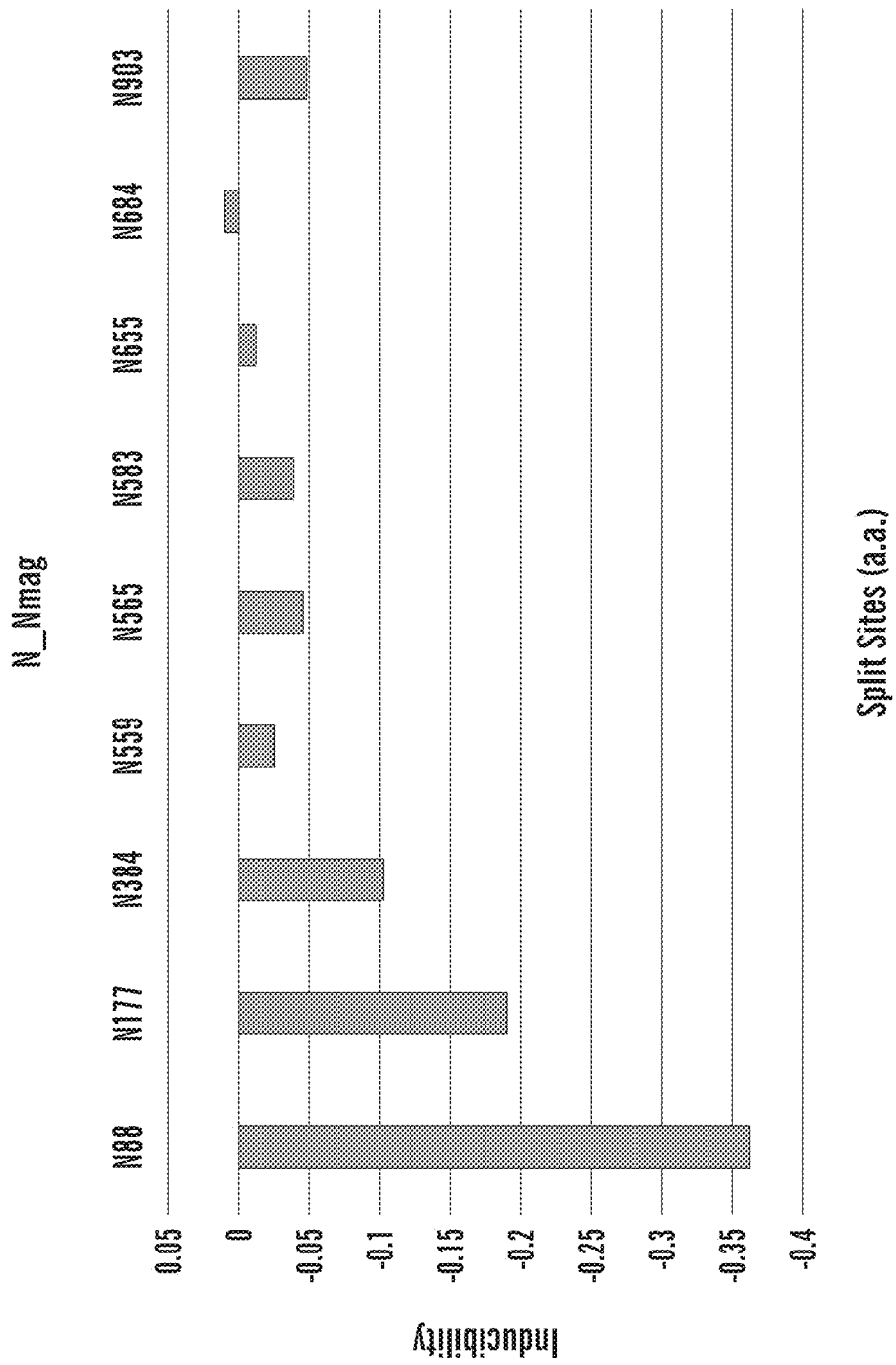
FIG. 19 is a bar graph showing the inducibility of different blue light-inducible N-nMag and C-pMag Cas13d constructs split at the sites listed on the x-axis. The orientation of these constructs had the nMag domain on the N-terminus of the N-terminal Cas13d fragment and the pMag domain on the C-terminus of the C-terminal Cas13d fragment. Inducibility was low in this orientation compared to the opposite orientation (see e.g., FIG. 20).
Figure 20:
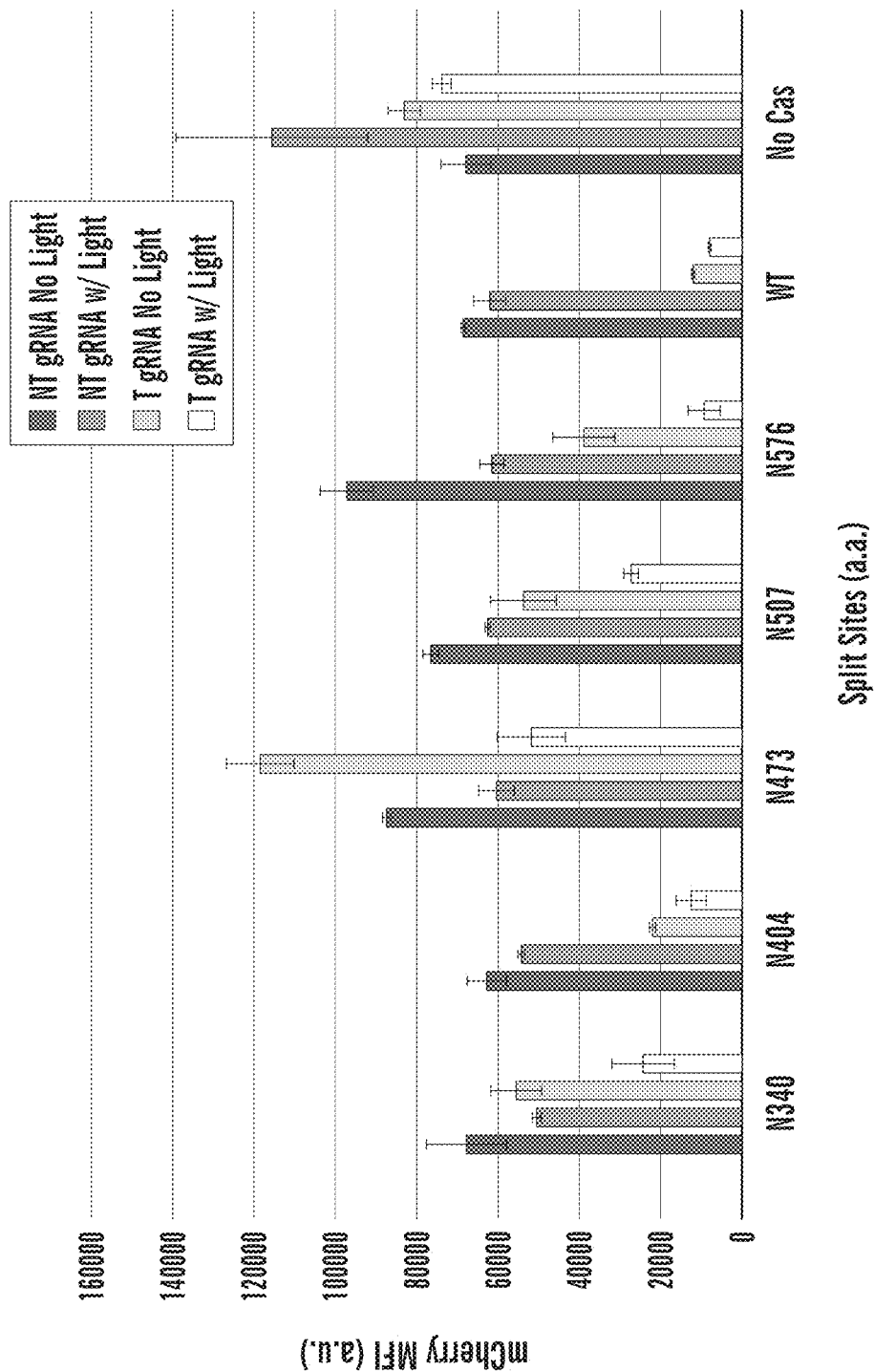
FIG. 20 is a bar graph showing inducibility for 15 minutes of blue light at 10 mW/cm^2. When Pmag was on the N-terminus of the N-terminal split Cas13d and Nmag was on the C-terminus of the C-terminal split Cas13d, inducibility was more effective than that of the opposite orientation (see e.g., FIG. 19). The left-right order of the bars for each split site is the same as the top-down order of the legend for the bar graph.

Split sites that demonstrate good to moderate knockdown performance can be fused to light inducible domains, including but not limited to the blue light inducible domains such as CRY1/CIB2 and the Magnets (e.g., pMag, nMag). Systems can be transiently transfected into HEK 293 FT cells, and experimental groups can be exposed to light at the corresponding wavelength during incubation, while the control is kept from light (see e.g., FIG. 18-20). Knockdown activity of light inducible split Cas13d can be tested with a range of light intensities. As light induced dimerization is easily reversible, system performance can be evaluated with different lengths of light exposure, numbers of exposures, and/or time between exposures. Flow cytometry and qPCR can be used to quantify knockdown activity induced by light.

F. An RNA Sensing Device with Cas13 Connected to a Split Recombinase

As transcriptomic changes are an important process during cell development that can be transient and hard to observe, real-time imaging is often required for such purposes. However, this approach is both time-consuming and labor-intensive. Therefore, a device that recognizes transcriptomic changes and generates output with memory can allow for measurement of transient changes of RNA expression in cell development. To achieve this, it is contemplated herein that split recombinase can be fused to Cas13, with 2 guide targeting nearby regions on a RNA transcript (see e.g., FIG. 25); Cas13's each with a split recombinase piece can be brought into close proximity, and reconstituted recombinase can turn on its reporter expression permanently. Split Cre and Flp that generated large ON/OFF dynamic range with various inducible systems can be fused to split Cas13d's, WT Cas13d's, and other Cas13's. Fusing split recombinases to split Cas13d's can generate constitutive recombinase reporter expression. As described herein, split Cas13d's were able to target and knockdown target expression in the presence of gRNA, and it is likely that gRNA-induced the dimerization of the Cas13d splits can result in constitutive recombinase activity if dimerization orientation is suitable for recombinase reconstitution. Therefore, it is contemplated herein that WT Cas13d can be suitable for this application. A study with the recombinase splits fused to the same version of Cas13d can be conducted. However, in this case, gRNAs targeting close regions on the target RNA could bring together the same moiety of the split recombinase (e.g., both N-terminal moieties or both C-terminal moieties) which would compromise the overall performance of the system and result in less efficient recombination. Thus, a system with 2 different Cas13 effectors that recognize their gRNA orthogonally can be used. All 3 designs can be tested in conditions with and without gRNA and target RNA. Only recombinase activity in conditions with both target gene expression and targeting gRNAs indicates a functional system.

G. Logical Genetic Manipulation Using Cas13

Cas13 orthologs, Cas13a from *Leptotrichia wadei* (also referred to herein as LwaCas13a or Cas13a, previously known as C2c2) and Cas13b from *Prevotella* sp. P5-125 (also referred to herein as PspCas13b or Cas13b) have also been demonstrated to function with high on-target and low off-target activity in mammalian systems. To build orthogonal inducible Cas13s, it is contemplated herein that the sequences of these Cas13s can be obtained and aligned with sequence of RfxCas13d. Split sites can be chosen based on successful split sites in RfxCas13d, and split Cas13a and Cas13b fragments can be cloned into backbones built for Cas13d. Knockdown activity can be verified with both transgenes and endogenous genes. As these Cas13 effectors require orthogonal gRNA for targeting purposes, when they are coupled with orthogonal CID domains, the entire system can be orthogonal, and multiplexed control of target knockdown can be achieved.

Accordingly, based on structural alignment of LwaCas13a and PspCas13b with RfxCas13d, split sites were determined within the sequences of LwaCas13a and PspCas13b that matched the split sites in RfxCas13d that demonstrated activity. To establish a comparable screening method for split Cas13a and Cas13b, first an mCherry-targeting Cas13a and Cas13b crRNAs (i.e., gRNAs) were generated, targeting positions in mCherry matched to those targeted by Cas13d. Cas13b was able to facilitate over 70% mCherry knockdown. The position-matched LwaCas13a crRNA did not achieve mCh knockdown compared to no crRNA control group. Two additional mCherry-targeting crRNA sequences for LwaCas13a were identified; they both offered moderate mCherry knockdown (around 50% in populations highly expressing Cas13a).

With the LwaCas13a and PspCas13b specific mCherry-targeting crRNAs, 12 split sites were screened in PspCas13b, and 11 split sites were screened in LwaCas13a sequences. For PspCas13b, as it has been reported to be the most active when directed to the cytosol, 2 designs were tested, wherein the C split pieces was directed to the cytosol, while N piece was directed to either the cytosol or the nucleus: (1) the N split piece was directed to the nucleus, while the C piece (using an NLS) was directed to the cytosol (using an NES; see e.g., FIG. 21A); or (2) the N split piece was directed to the cytosol (using an NES), and the C piece was also directed to the cytosol (using an NES; see e.g., FIG. 21B).

Through screening, PspCas13b, when split at amino acid 49/50, 177/178, 250/251, 431/432, or 1065/1066 and coupled with the GIB CIDs (in the orientation: N-GID, GAI-C) was able to generate GIB-dependent mCherry knockdown (see e.g., FIG. 21A-21B). For LwaCas13a, screening with the GIB CIDs revealed that split 416/417 or 421/422 was able to knockdown mCherry expression to a level comparable to that achieved the WT LwaCas13a (see e.g., FIG. 22). The fact that the overall knockdown efficiency of these two LwaCas13a splits was comparable to that by WT LwaCas13a indicates that low knockdown efficiency can be due to the targeting efficiency of the applied crRNA. Therefore, it is contemplated herein that the knockdown efficiency of split LwaCas13a can be brought up by optimized crRNA design. Moreover, without wishing to be bound by theory, with a more efficient crRNA, GIB-induced knockdown efficiency by splits 397/398, 488/489, 605/606, 786/787, or 826/827 could also be enhanced.

It is contemplated herein that the inducibility of the LwaCas13a and PspCas13b splits that offered good to moderate knockdown efficiency toward mCherry can be tested with other CID systems, and applied to target endogenous gene expression.

---

SEQUENCE LISTING (2169 sequences)

SEQ ID NO: 1 - protein, 966 aa, Ruminococcus flavefaciens
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 2 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENGITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 3 - protein, 1089 aa, Prevotella pectinovora
NIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 4 - protein, 88 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYT

SEQ ID NO: 5 - protein, 878 aa, Artificial Sequence
  synthetic polypeptide
GPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 6 - protein, 149 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGL

SEQ ID NO: 7 - protein, 817 aa, Artificial Sequence
  synthetic polypeptide
DKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 8 - protein, 177 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAA

SEQ ID NO: 9 - protein, 789 aa, Artificial Sequence
  synthetic polypeptide
FNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 10 - protein, 180 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNN

SEQ ID NO: 11 - protein, 786 aa, Artificial Sequence
  synthetic polypeptide
NDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 12 - protein, 215 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKE

SEQ ID NO: 13 - protein, 751 aa, Artificial Sequence
  synthetic polypeptide
GRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 14 - protein, 263 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNL

SEQ ID NO: 15 - protein, 703 aa, Artificial Sequence
  synthetic polypeptide
DNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 16 - protein, 317 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSI

SEQ ID NO: 17 - protein, 649 aa, Artificial Sequence
  synthetic polypeptide
MKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 18 - protein, 340 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKD

SEQ ID NO: 19 - protein, 626 aa, Artificial Sequence
  synthetic polypeptide
MSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 20 - protein, 384 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSL

SEQ ID NO: 21 - protein, 582 aa, Artificial Sequence
  synthetic polypeptide
PDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 22 - protein, 404 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGS

SEQ ID NO: 23 - protein, 562 aa, Artificial Sequence
  synthetic polypeptide
FNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 24 - protein, 456 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILP

SEQ ID NO: 25 - protein, 510 aa, Artificial Sequence
  synthetic polypeptide
AGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 26 - protein, 473 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTM

SEQ ID NO: 27 - protein, 493 aa, Artificial Sequence
  synthetic polypeptide
FLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 28 - protein, 507 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVN

SEQ ID NO: 29 - protein, 459 aa, Artificial Sequence
  synthetic polypeptide
AKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 30 - protein, 559 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNL

SEQ ID NO: 31 - protein, 407 aa, Artificial Sequence
  synthetic polypeptide
SYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 32 - protein, 565 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELK

SEQ ID NO: 33 - protein, 401 aa, Artificial Sequence
  synthetic polypeptide
ALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 34 - protein, 576 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDEN

SEQ ID NO: 35 - protein, 390 aa, Artificial Sequence
  synthetic polypeptide
GNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 36 - protein, 583 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKG

SEQ ID NO: 37 - protein, 383 aa, Artificial Sequence
  synthetic polypeptide
KHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 38 - protein, 655 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGK

SEQ ID NO: 39 - protein, 311 aa, Artificial Sequence
  synthetic polypeptide
DKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 40 - protein, 684 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKR

SEQ ID NO: 41 - protein, 282 aa, Artificial Sequence
  synthetic polypeptide
SVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 42 - protein, 721 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNI

SEQ ID NO: 43 - protein, 245 aa, Artificial Sequence
  synthetic polypeptide
NARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 44 - protein, 747 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDIN

SEQ ID NO: 45 - protein, 219 aa, Artificial Sequence
  synthetic polypeptide
LKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 46 - protein, 755 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKG

SEQ ID NO: 47 - protein, 211 aa, Artificial Sequence
  synthetic polypeptide
FSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 48 - protein, 769 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDET

SEQ ID NO: 49 - protein, 197 aa, Artificial Sequence
  synthetic polypeptide
APDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 50 - protein, 795 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESA

SEQ ID NO: 51 - protein, 171 aa, Artificial Sequence
  synthetic polypeptide
NPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 52 - protein, 807 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYS

SEQ ID NO: 53 - protein, 159 aa, Artificial Sequence
  synthetic polypeptide
DEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 54 - protein, 848 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRI

SEQ ID NO: 55 - protein, 118 aa, Artificial Sequence
  synthetic polypeptide
DNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNS

SEQ ID NO: 56 - protein, 903 aa, Artificial Sequence
  synthetic polypeptide
IEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSS

SEQ ID NO: 57 - protein, 63 aa, Artificial Sequence
  synthetic polypeptide
GKVSEYFDAVNDEKKYNDRLLKLLCVPFGYCIPRFKNLSIEALFDRNEAAKFDKEKKKVSGNS

SEQ ID NO: 58 - protein, 343 aa, Escherichia virus P1
MSNLLTVHQNLPALPVDATSDEVRKNLMDMFRDRQAFSEHTWKMLLSVCRSWAAWCKLNNRKWFPAEPEDVRDYLLYLQARGLAVKTIQQHLGQLNMLHRRSGLPRPSDSNAVSLVMRRIRKENVDAGERAKQALAFERTDFDQVRSLMENSDRCQDIRNLAFLGIAYNTLLRIAEIARIRVKDISRTDGGRMLIHIGRTKTLVSTAGVEKALSLGVTKLVERWISVSGVADDPNNYLFCRVRKNGVAAPSATSQLSTRALEGIFEATHRLIYGAKDDSGQRYLAWSGHSARVGAARDMARAGVSIPEIMQAGGWTNVNIVMNYIRNLDSETGAMVRLLEDGD

SEQ ID NO: 59 - DNA, 34 bp, Artificial Sequence
  synthetic oligonucleotide
  misc_feature (14)..(16): n is a, c, g, or t
  misc_feature (19)..(21): n is a, c, g, or t
ataacttcgtatannntannntatacgaagttat

SEQ ID NO: 60 - protein, 423 aa, Saccharomyces cerevisiae
MSQFDILCKTPPKVLVRQFVERFERPSGEKIASCAAELTYLCWMITHNGTAIKRATFMSYNTIISNSLSFDIVNKSLQFKYKTQKATILEASLKKLIPAWEFTIIPYNGQKHQSDITDIVSSLQLQFESSEEADKGNSHSKKMLKALLSEGESIWEITEKILNSFEYTSRFTKTKTLYQFLFLATFINCGRFSDIKNVDPKSFKLVQNKYLGVIIQCLVTETKTSVSRHIYFFSARGRIDPLVYLDEFLRNSEPVLKRVNRTGNSSSNKQEYQLLKDNLVRSYNKALKKNAPYPIFAIKNGPKSHIGRHLMTSFLSMKGLTELTNVVGNWSDKRASAVARTTYTHQITAIPDHYFALVSRYYAYDPISKEMIALKDETNPIEEWQHIEQLKGSAEGSIRYPAWNGIISQEVLDYLSSYINRRI

SEQ ID NO: 61 - DNA, 34 bp, Artificial Sequence
  synthetic oligonucleotide
gaagttcctattctctagaaagtataggaacttc

SEQ ID NO: 62 - protein, 605 aa, Streptomyces virus phiC31
MDTYAGAYDRQSRERENSSAASPATQRSANEDKAADLQREVERDGGRFRFVGHFSEAPGTSAFGTAERPEFERILNECRAGRLNMIIVYDVSRFSRLKVMDAIPIVSELLALGVTIVSTQEGVFRQGNVMDLIHLIMRLDASHKESSLKSAKILDTKNLQRELGGYVGGKAPYGFELVSETKEITRNGRMVNVVINKLAHSTTPLTGPFEFEPDVIRWWWREIKTHKHLPFKPGSQAAIHPGSITGLCKRMDADAVPTRGETIGKKTASSAWDPATVMRILRDPRIAGFAAEVIYKKKPDGTPTTKIEGYRIQRDPITLRPVELDCGPIIEPAEWYELQAWLDGRGRGKGLSRGQAILSAMDKLYCECGAVMTSKRGEESIKDSYRCRRRKVVDPSAPGQHEGTCNVSMAALDKFVAERIFNKIRHAEGDEETLALLWEAARRFGKLTEAPEKSGERANLVAERADALNALEELYEDRAAGAYDGPVGRKHFRKQQAALTLRQQGAEERLAELEAAEAPKLPLDQWFPEDADADPTGPKSWWGRASVDDKRVFVGLFVDKIVVTKSTTGRGQGTPIEKRASITWAKPPTDDDEDDAQDGTEDVAA

SEQ ID NO: 63 - DNA, 45 bp, Artificial Sequence
  synthetic oligonucleotide
tgcgggtgccagggcgtgcccttgggctccccgggcgcgtactcc

SEQ ID NO: 64 - DNA, 42 bp, Artificial Sequence
  synthetic oligonucleotide
gtgccccaactggggtaacctttgagttctctcagttggggg

SEQ ID NO: 65 - protein, 380 aa, Artificial Sequence
  synthetic polypeptide
MIENQLSLLGDFSGVRPDDVKTAIQAAQKKGINVAENEQFKAAFEHLLNEFKKREERYSPNTLRRLESAWTCFVDWCLANHRHSLPATPDTVEAFFIERAEELHRNTLSVYRWAISRVHRVAGCPDPCLDIYVEDRLKAIARKKVREGEAVKQASPFNEQHLLKLTSLWYRSDKLLLRRNLALLAVAYESMLRASELANIRVSDMELAGDGTAILTIPITKTNHSGEPDTCILSQDVVSLLMDYTEAGKLDMSSDGFLFVGVSKHNTCIKPKKDKQTGEVLHKPITTKTVEGVFYSAWETLDLGRQGVKPFTAHSARVGAAQDLLKKGYNTLQIQQSGRWSSGAMVARYGRAILARDGAMAHSRVKTRSAPMQWGKDEKD

SEQ ID NO: 66 - DNA, 34 bp, Artificial Sequence
  synthetic oligonucleotide
tcaatttctgagaactgtcattctcggaaattga

SEQ ID NO: 67 - protein, 568 aa, Zygosaccharomyces bisporus
MSSYMDLVDDEPATLYHKFVECLKAGENFCGDKLSGIITMAILKAIKALTEVKKTTFNKYKTTIKQGLQYDVGSSTISFVYHLKDCDELSRGLSDAFEPYKFKIKSNKEATSFKTLFRGPSFGSQKNWRKKEVDREVDNLFHSTETDESIFKFILNTLDSIETQTNTDRQKTVLTFILLMTFFNCCRNNDLMNVDPSTFKIVKNKFVGYLLQAEVKQTKTRKSRNIFFFPIRENRFDLFLALHDFFRTCQPTPKSRLSDQVSEQKWQLFRDSMVIDYNRFFRKFPASPIFAIKHGPKSHLGRHLMNSFLHKNELDSWANSLGNWSSSQNQRESGARLGYTHGGRDLPQPLFGFLAGYCVRNEEGHIVGLGLEKDINDLFDGIMDPLNEKEDTEICESYGEWAKIVSKDVLIFLKRYHSKNACRRYQNSTLYARTFLKTESVTLSGSKGSEEPSSPVRIPILSMGKASPSEGRKLRASEHANDDNEIEKIDSDSSQSEEIPIEMSDSEDETTASNISGIYLDMSKANSNVVYSPPSQTGRAAGAGRKRGVGGRRTVESKRRRVLAPINR

SEQ ID NO: 68 - DNA, 33 bp, Artificial Sequence
  synthetic oligonucleotide
ggttgcttaagaataagtaattcttaagcaacc

SEQ ID NO: 69 - protein, 500 aa, Mycobacteriophage Bxb1 [sequence omitted]

SEQ ID NO: 70 - DNA, 50 bp, Artificial Sequence
  synthetic oligonucleotide
tcggccggcttgtcgacgacggcggtctccgtcgtcaggatcatccgggc

SEQ ID NO: 71 - DNA, 58 bp, Artificial Sequence
  synthetic oligonucleotide
gtcgtggtttgtctggtcaaccaccgcggtctcagtggtgtacggtacaaaccccgac

SEQ ID NO: 72 - protein, 9 aa, Artificial Sequence
  synthetic polypeptide
MDPKKKRKV

SEQ ID NO: 73 - protein, 297 aa, Artificial Sequence
  synthetic polypeptide
PLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLK

SEQ ID NO: 74 - protein, 188 aa, Artificial Sequence
  synthetic polypeptide
APTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYA

SEQ ID NO: 75 - protein, 298 aa, Artificial Sequence
  synthetic polypeptide
VPLYGFTSICGRRPEMEAAVSTIPRFLQSSSGSMLDGRFDPQSAAHFFGVYDGHGGSQVANYCRERMHLALAEEIAKEKPMLCDGDTWLEKWKKALFNSFLRVDSEIESVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLK

SEQ ID NO: 76 - protein, 177 aa, Artificial Sequence
  synthetic polypeptide
TQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMN

SEQ ID NO: 77 - protein, 109 aa, Artificial Sequence
  synthetic polypeptide
SRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 78 - protein, 92 aa, Artificial Sequence
  synthetic polypeptide
ILWHEMWHEGLEEASRLYFGERNVKGMFEVLEPLHAMMERGPQTLKETSFNQAYGRDLMEAQEWCRKYMKSGNVKDLLQAWDLYYHVFRRIS

SEQ ID NO: 79 - protein, 92 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLN

SEQ ID NO: 80 - protein, 345 aa, Artificial Sequence
  synthetic polypeptide
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 81 - protein, 150 aa, Artificial Sequence
  synthetic polypeptide
HTLYAPGGYDIMGYLDQIGNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETE

SEQ ID NO: 82 - protein, 150 aa, Artificial Sequence
  synthetic polypeptide
HTLYAPGGYDIMGYLRQIRNRPNPQVELGPVDTSCALILCDLKQKDTPIVYASEAFLYMTGYSNAEVLGRNCRFLQSPDGMVKPKSTRKYVDSNTINTMRKAIDRNAEVQVEVVNFKKNGQRFVNFLTMIPVRDETGEYRYSMGFQCETE

SEQ ID NO: 83 - protein, 171 aa, Artificial Sequence
  synthetic polypeptide
MNGAIGGDLLLNFPDMSVLERQRAHLKYLNPTFDSPLAGFFADSSMITGGEMDSYLSTAGLNLPMMYGETTVEGDSRLSISPETTLGTGNFKKRKFDTETKDCNEKKKKMTMNRDDLVEEGEEEKSKITEQNNGSTKSIKKMKHKAKKEENNFSNDSSKVTKELEKTDYIH

SEQ ID NO: 84 - protein, 612 aa, Artificial Sequence
  synthetic polypeptide
MKMDKKTIVWFRRDLRIEDNPALAAAAHEGSVFPVFIWCPEEEGQFYPGRASRWWMKQSLAHLSQSLKALGSDLTLIKTHNTISAILDCIRVTGATKVVFNHLYDPVSLVRDHTVKEKLVERGISVQSYNGDLLYEPWEIYCEKGKPFTSFNSYWKKCLDMSIESVMLPPPWRLMPITAAAEAIWACSIEELGLENEAEKPSNALLTRAWSPGWSNADKLLNEFIEKQLIDYAKNSKKVVGNSTSLLSPYLHFGEISVRHVFQCARMKQIIWARDKNSEGEESADLFLRGIGLREYSRYICFNFPFTHEQSLLSHLRFFPWDADVDKFKAWRQGRTGYPLVDAGMRELWATGWMHNRIRVIVSSFAVKFLLLPWKWGMKYFWDTLLDADLECDILGWQYISGSIPDGHELDRLDNPALQGAKYDPEGEYIRQWLPELARLPTEWIHHPWDAPLTVLKASGVELGTNYAKPIVDIDTARELLAKAISRTREAQIMIGAAPDEIVADSFEALGANTIKEPGLCPSVSSNDQQVPSAVRYNGSKRVKPEEEEERDMKKSRGFDERELFSTAESSSSSSVFFVSQSCSLASEGKNLEGIQDSSDQITTSLGKNGCK

SEQ ID NO: 85 - protein, 224 aa, Artificial Sequence
  synthetic polypeptide
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTEKLYVRDGVLKGDVNMALSLEGGGHYRCDFKTTYKAKKVVQLPDYHFVDHHIEIKSHDKDYSNVNLHEHAEAHSELPRQAK

SEQ ID NO: 86 - protein, 224 aa, Artificial Sequence
  synthetic polypeptide
MSVIKPDMKIKLRMEGAVNGHPFAIEGVGLGKPFEGKQSMDLKVKEGGPLPFAYDILTTVFCYGNRVFAKYPENIVDYFKQSFPEGYSWERSMNYEDGGICNATNDITLDGDCYIYEIRFDGVNFPANGPVMQKRTVKWEPSTENLYVRDGVLKGDVNMALSLEGGGHYRCDFKTTYKAKKVVQLPDYHFVDHHIEIKSHDKDYSNVNLHEHAEAHSELPRQAK

SEQ ID NO: 87 - protein, 224 aa, Artificial Sequence
  synthetic polypeptide
MSVIKPDMKIKLRMEGAVNGHPFAIEGVGLGKPFEGKQSMDLKVKEGGPLPFAYDILTMAFCYGNRVFAKYPENIVDYFKQSFPEGYSWERSMHYEDGGSCNATNDITLDGDCYIYEIRFDGVNFPANGPVMQKRTVKWERSTENLYVRDGVLKSDGNYALSLEGGGHYRCDFKTTYKAKKVVQLPDYHSVDHHIEIKSHDKDYSNVNLHEHAEAHSELPRQAN

SEQ ID NO: 88 - protein, 236 aa, Artificial Sequence
  synthetic polypeptide
MVSKGEENNMAIIKEFMRFKVHMEGSVNGHEFEIEGEGEGRPYEAFQTAKLKVTKGGPLPFAWDILSPQFMYGSKVYIKHPADIPDYFKLSFPEGFRWERVMNFEDGGIIHVNQDSSLQDGVFIYKVKLRGTNFPSDGPVMQKKTMGWEASEERMYPEDGAHKAEIKKRLKLKDGGHYAAEVKTTYKAKKPVQLPGAYIVDIKLDIVSHNEDYTIVEQYERAEGRHSTGGMDELYK

SEQ ID NO: 89 - protein, 189 aa, Artificial Sequence
  synthetic polypeptide
APITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMRSPVFTDNSS

SEQ ID NO: 90 - protein, 180 aa, Artificial Sequence
  synthetic polypeptide
APITAYAQQTRGLLGCIITSLTGRDKNQVEGEVQIVSTATQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVAKAVDFIPVENLETTMR

SEQ ID NO: 91 - protein, 180 aa, Artificial Sequence
  synthetic polypeptide
APITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSSGGPLLCPSGHAVGIFRAAVCTRGVAKAVDFVPVESMETTMR

SEQ ID NO: 92 - protein, 180 aa, Artificial Sequence
  synthetic polypeptide
APITAYAQQTRGLLGTIVVSMTGRDKTEQAGEIQVLSTVTQSFLGTSISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTR

SEQ ID NO: 93 - protein, 180 aa, Artificial Sequence
  synthetic polypeptide
APITAYAQQTRGLLGTIVTSLTGRDKNVVTGEVQVLSTATQTFLGTTVGGVIWTVYHGAGSRTLAGAKHPALQMYTNVDQDLVGWPAPPGAKSLEPCACGSSDLYLVTRDADVIPARRRGDSTASLLSPRPLACLKGSSGGPVMCPSGHVAGIFRAAVCTRGVAKSLQFIPVETLSTQAR

SEQ ID NO: 94 - protein, 180 aa, Artificial Sequence
  synthetic polypeptide
APITAYAQQTRGLFSTIVTSLTGRDTNENCGEVQVLSTATQSFLGTAVNGVMWTVYHGAGAKTISGPKGPVNQMYTNVDQDLVGWPAPPGVRSLAPCTCGSADLYLVTRHADVIPVRRRGDTRGALLSPRPISILKGSSGGPLLCPMGHRAGIFRAAVCTRGVAKAVDFVPVESLETTMR

SEQ ID NO: 95 - protein, 180 aa, Artificial Sequence
  synthetic polypeptide
APITAYAQQTRGVLGAIVLSLTGRDKNEAEGEVQFLSTATQTFLGICINGVMWTLFHGAGSKTLAGPKGPVVQMYTNVDKDLVGWPSPPGKGSLTRCTCGSADLYLVTRHADVIPARRRGDTRASLLSPRPISYLKGSSGGPIMCPSGHVVGVFRAAVCTRGVAKALEFVPVENLETTMR

SEQ ID NO: 96 - protein, 180 aa, Artificial Sequence
  synthetic polypeptide
APITAYAQQTRGLVGTIVTSLTGRDKNEAEGEVQVVSTATQSFLATTINGVLWTVYHGAGSKNLAGPKGPVCQMYTNVDQDLVGWPAPLGARSLAPCTCGSSDLYLVTRGADVIPARRRGDTRAALLSPRPISTLKGSSGGPLMCPSGHVVGLFRAAVCTRGVAKALDFIPVENMDTTMR

SEQ ID NO: 97 - protein, 180 aa, Artificial Sequence
  synthetic polypeptide
APISAYAQQTRGLISTLVVSLTGRDKNETAGEVQVLSTSTQTFLGTNVGGVMWGPYHGAGTRTVAGRGGPVLQMYTSVSDDLVGWPAPPGSKSLEPCSCGSADLYLVTRNADVLPLRRKGDGTASLLSPRPVSSLKGSSGGPVLCPQSHCVGIFRAAVCTRGVAKAVQFVPIEKMQVAQR

SEQ ID NO: 98 - protein, 180 aa, Artificial Sequence
  synthetic polypeptide
APITAYAQQTRGLLGCIITSLTGRDKNQVEGEVQIVSTATQTFLATCINGVCWTVYHGAGTRTIASPKGPVIQMYTNVDQDLVGWPAPQGSRSLTPCTCGSSDLYLVTRHADVIPVRRRGDSRGSLLSPRPISYLKGSSGGPLLCPAGHAVGLFRAAVCTRGVTKAVDFIPVENLETTMR

SEQ ID NO: 99 - protein, 180 aa, Artificial Sequence
  synthetic polypeptide
APITAYSQQTRGLLGCIITSLTGRDKNQVEGEVQVVSTATQSFLATCVNGVCWTVYHGAGSKTLAAPKGPITQMYTNVDQDLVGWPKPPGARSLTPCTCGSSDLYLVTRHADVIPVRRRGDSRGSLLSPRPVSYLKGSSGGPLLCPFGHAVGIFRAAVCTRGVAKAVDFVPVESMETTMR

SEQ ID NO: 100 - protein, 180 aa, Artificial Sequence
  synthetic polypeptide
APITAYAQQTRGLLGTIVVSMTGRDKTEQAGEIQVLSTVTQSFLGTTISGVLWTVYHGAGNKTLAGSRGPVTQMYSSAEGDLVGWPSPPGTKSLEPCTCGAVDLYLVTRNADVIPARRRGDKRGALLSPRPLSTLKGSSGGPVLCPRGHAVGVFRAAVCSRGVAKSIDFIPVETLDIVTR

SEQ ID NO: 101 - protein, 180 aa, Artificial Sequence
  synthetic polypeptide
APITAYTQQTRGLLGAIVVSLTGRDKNEQAGQVQVLSSVTQTFLGTSISGVLWTVYHGAGNKTLAGPKGPVTQMYTSAEGDLVGWPSPPGTKSLDPCTCGAVDLYLVTRNADVIPVRRKDDRRGALLSPRPLSTLKGSSGGPVLCSRGHAVGLFRAAVCARGVAKSIDFIPVESLDVATR

SEQ ID NO: 102 - protein, 180 aa, Artificial Sequence; identical to SEQ ID NO: 93
  synthetic polypeptide

SEQ ID NO: 103 - protein, 179 aa, Artificial Sequence
  synthetic polypeptide
ITAYSQQTRGLLGCIITSLTGRDKNQVEGEVQVVSTATQSFLATCVNGVCWTVYHGAGSKTLAGPKGPITQMYTNVDQDLVGWQAPPGARSLTPCTCGSSDLYLVTRHADVIPVRRRGDSRGSLLSPRPVSYLKGSAGGPLLCPSGHAVGIFRAAVCTRGVAKAVDFVPVESMETTMRS

SEQ ID NO: 104 - protein, 189 aa, Artificial Sequence
  synthetic polypeptide
APITAYAQQTRGLLGCIITSLTGRDKNQVEGEVQIVSTATQTFLATCINGVCWAVYHGAGTRTIASPKGPVIQMYTNVDQDLVGWPAPQGSRSLTPCTCGSSDLYLVTRHADVIPVRRRGDSRGSLLSPRPISYLKGSAGGPLLCPAGHAVGLFRAAVCTRGVAKAVDFIPVENLETTMRSPVFTDNSS

SEQ ID NO: 105 - protein, 13 aa, Artificial Sequence
  synthetic polypeptide
GCVVIVGRIVLSG

SEQ ID NO: 106 - DNA, 39 bp, Artificial Sequence
  synthetic polynucleotide
ggctgcgtggtcatagtgggcaggatcgtcttgtccgga

SEQ ID NO: 107 - DNA, 36 bp, Artificial Sequence
  synthetic polynucleotide
ggttctgttgttattgttggtagaattattttatct

SEQ ID NO: 108 - protein, 12 aa, Artificial Sequence
  synthetic polypeptide
GSVVIVGRIILS

SEQ ID NO: 109 - protein, 14 aa, Artificial Sequence
  synthetic polypeptide
GCVVIVGRIVLSGK

SEQ ID NO: 110 - protein, 14 aa, Artificial Sequence
  synthetic polypeptide
GCVCIIGRLHINQR

SEQ ID NO: 111 - protein, 14 aa, Artificial Sequence
  synthetic polypeptide
GCVVIVGHIELEGK

SEQ ID NO: 112 - protein, 14 aa, Artificial Sequence
  synthetic polypeptide
GSVVIVGRVVLSGQ

SEQ ID NO: 113 - protein, 14 aa, Artificial Sequence
  synthetic polypeptide
GSVAIVGRIILSGR

SEQ ID NO: 114 - protein, 14 aa, Artificial Sequence
  synthetic polypeptide
GCVVICGRIVTSGK

SEQ ID NO: 115 - protein, 14 aa, Artificial Sequence
  synthetic polypeptide
GSVVVVGRVVLGSN

SEQ ID NO: 116 - protein, 54 aa, Artificial Sequence
  synthetic polypeptide
STWVLVGGVLAALAAYCLSTGCVVIVGRIVLSGKPAIIPDREVLYQEFDEMEEC

SEQ ID NO: 117 - protein, 54 aa, Artificial Sequence
  synthetic polypeptide
STWVLVGGVLAALAAYCLSTGCVVIVGRVVLSGKPAIIPDREVLYREFDEMEEC

SEQ ID NO: 118 - protein, 54 aa, Artificial Sequence
  synthetic polypeptide
STWVLVGGVLAALAAYCLSTGCVVIVGRIVLSGRPAIIPDREVLYREFDEMEEC

SEQ ID NO: 119 - protein, 54 aa, Artificial Sequence
  synthetic polypeptide
STWVLVGGVLAALAAYCLTTGSVVIVGRIILSGRPAIVPDRELLYQEFDEMEEC

SEQ ID NO: 120 - protein, 54 aa, Artificial Sequence
  synthetic polypeptide
STWVLVGGVLAALAAYCLTTGSVVIVGRIILSGRPAIIPDRELLYQEFDEMEEC

SEQ ID NO: 121 - protein, 54 aa, Artificial Sequence
  synthetic polypeptide
STWVLVGGVLAALAAYCLTTGSVVIVGRIILSGKPAVVPDRELLYQEFDEMEEC

SEQ ID NO: 122 - protein, 54 aa, Artificial Sequence
  synthetic polypeptide
STWVLVGGVLAALAAYCLTTGSVVIVGRIILSGRPAVIPDRELLYREFDEMEEC

SEQ ID NO: 123 - protein, 54 aa, Artificial Sequence
  synthetic polypeptide
STWVLAGGVLAAVAAYCLATGCVCIIGRLHVNQRAVVAPDKEVLYEAFDEMEEC

SEQ ID NO: 124 - protein, 54 aa, Artificial Sequence
  synthetic polypeptide
STWVLAGGVLAAVAAYCLATGCVSIIGRLHINGRAVVAPDKEVLYEAFDEMEEC

SEQ ID NO: 125 - protein, 54 aa, Artificial Sequence
  synthetic polypeptide
SSWVLAGGVLAAVAAYCLATGCISIIGRLHLNDRVVVAPDKEILYEAFDEMEEC

SEQ ID NO: 126 - protein, 54 aa, Artificial Sequence
  synthetic polypeptide
STWVLAGGVLAAVAAYCLATGCVSIIGRLHLNDQVVVTPDKEILYEAFDEMEEC

SEQ ID NO: 127 - protein, 54 aa, Artificial Sequence
  synthetic polypeptide
STWVLLGGVLAALAAYCLSVGCVVIVGHIELEGKPALVPDKEVLYQQYDEMEEC

SEQ ID NO: 128 - protein, 54 aa, Artificial Sequence
  synthetic polypeptide
STWVLLGGVLAAVAAYCLSVGCVVIVGHIELGGKPALVPDKEVLYQQYDEMEEC

SEQ ID NO: 129 - protein, 4 aa, Artificial Sequence
  synthetic polypeptide
SGTS

SEQ ID NO: 130 - protein, 4 aa, Artificial Sequence
  synthetic polypeptide
GSGS

SEQ ID NO: 131 - protein, 10 aa, Artificial Sequence
  synthetic polypeptide
EDVVCCHSIY

SEQ ID NO: 132 - protein, 14 aa, Artificial Sequence
  synthetic polypeptide
LYQEFDEMEECSQH

SEQ ID NO: 133 - protein, 20 aa, Artificial Sequence
  synthetic polypeptide
CMSADLEVVTSTWVLVGGVL

SEQ ID NO: 134 - protein, 20 aa, Artificial Sequence
  synthetic polypeptide
CMSADLEVVTSTWVLVGGVL

SEQ ID NO: 135 - protein, 20 aa, Artificial Sequence
  synthetic polypeptide
CMQADLEVMTSTWVLAGGVL

SEQ ID NO: 136 - protein, 20 aa, Artificial Sequence
  synthetic polypeptide
CMQADLEIMTSSWVLAGGVL

SEQ ID NO: 137 - protein, 20 aa, Artificial Sequence
  synthetic polypeptide
CMSADLEVTTSTWVLLGGVL

SEQ ID NO: 138 - protein, 20 aa, Artificial Sequence
  synthetic polypeptide
YQEFDEMEECSQHLPYIEQG

SEQ ID NO: 139 - protein, 20 aa, Artificial Sequence
  synthetic polypeptide
YQEFDEMEECASHLPYIEQG

SEQ ID NO: 140 - protein, 20 aa, Artificial Sequence
  synthetic polypeptide
YEAFDEMEECASRAALIEEG

SEQ ID NO: 141 - protein, 20 aa, Artificial Sequence
  synthetic polypeptide
YEAFDEMEECASKAALIEEG

SEQ ID NO: 142 - protein, 20 aa, Artificial Sequence
  synthetic polypeptide
YQQYDEMEECSQAAPYIEQA

SEQ ID NO: 143 - protein, 20 aa, Artificial Sequence
  synthetic polypeptide
WISSECTTPCSGSWLRDVWD

SEQ ID NO: 144 - protein, 20 aa, Artificial Sequence
  synthetic polypeptide
WINEDCSTPCSGSWLRDVWD

SEQ ID NO: 145 - protein, 20 aa, Artificial Sequence
  synthetic polypeptide
WITEDCPIPCSGSWLRDVWD

SEQ ID NO: 146 - protein, 20 aa, Artificial Sequence
  synthetic polypeptide
WITEDCPVPCSGSWLQDIWD

SEQ ID NO: 147 - protein, 20 aa, Artificial Sequence
  synthetic polypeptide
WINEDYPSPCSDDWLRTIWD

SEQ ID NO: 148 - protein, 20 aa, Artificial Sequence
  synthetic polypeptide
GADTEDVVCCSMSYSWTGAL

SEQ ID NO: 149 - protein, 20 aa, Artificial Sequence
  synthetic polypeptide
EEASEDVVCCSMSYTWTGAL

SEQ ID NO: 150 - protein, 20 aa, Artificial Sequence
  synthetic polypeptide
SEEDDSVVCCSMSYSWTGAL

SEQ ID NO: 151 - protein, 20 aa, Artificial Sequence
  synthetic polypeptide
SDQEDSVICCSMSYSWTGAL

SEQ ID NO: 152 - protein, 20 aa, Artificial Sequence
  synthetic polypeptide
DSEEQSVVCCSMSYSWTGAL

SEQ ID NO: 153 - protein, 8 aa, Artificial Sequence
  synthetic polypeptide
HSIYGKKK

SEQ ID NO: 154 - protein, 182 aa, Artificial Sequence
  synthetic polypeptide
MAPITAYAQQTRGLLGCIITSLTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRS

SEQ ID NO: 155 - protein, 195 aa, Artificial Sequence
  synthetic polypeptide
MKKKGSVVIVGRIVLNGAYAQQTRGLLGCIITSLTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 156 - protein, 195 aa, Artificial Sequence
  synthetic polypeptide
MKKKGSVVIVGRIVLNGAYAQQTRGEEGCQETSQTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 157 - protein, 197 aa, Artificial Sequence
  synthetic polypeptide
MKKKGSVVIVGRINLSGDTAYAQQTRGEEGCQETSQTGRDKNQVEGEVQIVSTAAQTFLATCINGVCWTVYHGAGTRTIASPKGPVIQMYTNVDKDLVGWPAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 158 - protein, 197 aa, Artificial Sequence
  synthetic polypeptide
MKKKGSVVIVGRINLSGDTAYAQQTRGEEGCQETSQTGRDKNQVEGEVQIVSTATQTFLATCINGVCWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVCTRGVAKAVDFIPVESLETTMRSP

SEQ ID NO: 159 - protein, 197 aa, Artificial Sequence
  synthetic polypeptide
MKKKGSVVIVGRINLSGDTAYAQQTRGEEGCQETSQTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVSTRGVAKAVDFIPVESLETTMRSP

SEQ ID NO: 160 - protein, 197 aa, Artificial Sequence
  synthetic polypeptide
MKKKGSVVIVGRINLSGDTAYAQQTRGEQGCQKTSHTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVSTRGVAKAVDFIPVESLETTMRSP

SEQ ID NO: 161 - protein, 197 aa, Artificial Sequence
  synthetic polypeptide
MKKKGSVVIVGRINLSGDTAYAQQTRGEQGTQKTSHTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSSGGPLLCPAGHAVGIFRAAVSTRGVAKAVDFIPVESLETTMRSP

SEQ ID NO: 162 - protein, 196 aa, Artificial Sequence
  synthetic polypeptide
KKKGSVVIVGRINLSGDTAYAQQTRGEEGCQETSQTGRDKNQVEGEVQIVSTATQTFLATSINGVLWTVYHGAGTRTIASPKGPVTQMYTNVDKDLVGWQAPQGSRSLTPCTCGSSDLYLVTRHADVIPVRRRGDSRGSLLSPRPISYLKGSAGGPLLCPAGHAVGIFRAAVSTRGVAKAVDFIPVESLETTMRSP

SEQ ID NO: 163 - protein, 229 aa, Artificial Sequence
  synthetic polypeptide
SSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALHSIVYAIEAAIFALEAAERTGDPEVRELARELVRLAVEAAEEVQRNPSSRNVEHALMRIVLAIYLAEENLREAEESGDPEKREKARERVREAVERAEEVQRDPSGWLNH

SEQ ID NO: 164 - protein, 195 aa, Artificial Sequence
  synthetic polypeptide
LANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKS

SEQ ID NO: 165 - protein, 233 aa, Artificial Sequence
  synthetic polypeptide
DIEKLCKKAEEEAKEAQEKADELRQRHPDSQAAEDAEDLANLAVAAVLTACLLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKS

SEQ ID NO: 166 - protein, 229 aa, Artificial Sequence
  synthetic polypeptide
SSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALLTIVIAIEAAVNALEAAERTGDPEVRELARELVRLAVEAAEEVQRNPSSREVNIALWKIVLAIQEAVESLREAEESGDPEKREKARERVREAVERAEEVQRDPSGWLNH

SEQ ID NO: 167 - protein, 229 aa, Artificial Sequence
  synthetic polypeptide
SSDEEEARELIERAKEAAERAQEAAERTGDPRVRELARELKRLAQEAAEEVKRDPSSSDVNEALKLIVEAIEAAVDALEAAERTGDPEVRELARELVRLAVEAAEEVQRNPSSSDVNEALLSIVIAIEAAVHALEAAERTGDPEVRELARELVRLAVEAAEEVQRNPSSREVEHALMKIVLAIYEAEESLREAEESGDPEKREKARERVREAVERAEEVQRDPSGWLNH

SEQ ID NO: 168 - protein, 233 aa, Artificial Sequence
  synthetic polypeptide
DIEKLCKKAEEEAKEAQEKADELRQRHPDSQAAEDAEDLANEAEAAVLAACSLAQEHPNADIAKLCIKAASEAAEAASKAAELAQRHPDSQAARDAIKLASQAARAVILAIMLAAENPNADIAKLCIKAASEAAEAASKAAELAQRHPDSQAARDAIKLASQAAEAVERAIWLAAENPNADIAKKCIKAASEAAEEASKAAEEAQRHPDSQKARDEIKEASQKAEEVKERCKS

SEQ ID NO: 169 - protein, 15 aa, Artificial Sequence
  synthetic polypeptide
SSGGSGSGSSGGSGT

SEQ ID NO: 170 - protein, 21 aa, Artificial Sequence
  synthetic polypeptide
GELDELVYLLDGPGYDPIHSD

SEQ ID NO: 171 - protein, 33 aa, Artificial Sequence
  synthetic polypeptide
GELDELVYLLDGPGYDPIHCDVVTRGGSHLFNF

SEQ ID NO: 172 - protein, 33 aa, Artificial Sequence
  synthetic polypeptide
GELGRLVYLLDGPGYDPIHCSLAYGDASTLVVF

SEQ ID NO: 173 - protein, 18 aa, Artificial Sequence
  synthetic polypeptide
GELGRLVYLLDGPGYDPI

SEQ ID NO: 174 - protein, 15 aa, Artificial Sequence
  synthetic polypeptide
HCSLAYGDASTLVVF

SEQ ID NO: 175 - protein, 33 aa, Artificial Sequence
  synthetic polypeptide
GELGRPVYVLGDPGYYATHCIYATTNDALIFSV

SEQ ID NO: 176 - protein, 18 aa, Artificial Sequence
  synthetic polypeptide
GELGRPVYVLGDPGYYAT

SEQ ID NO: 177 - protein, 15 aa, Artificial Sequence
  synthetic polypeptide
HCIYATTNDALIFSV

SEQ ID NO: 178 - protein, 33 aa, Artificial Sequence
  synthetic polypeptide
GELGRIPSDTYDLAVGALHCPFYLVSGLVYLDG

SEQ ID NO: 179 - protein, 33 aa, Artificial Sequence
  synthetic polypeptide
GELGRLVYLLDGPGYDPIHCDVVTRGGSHLFNF

SEQ ID NO: 180 - protein, 33 aa, Artificial Sequence; identical to SEQ ID NO: 171
  synthetic polypeptide

SEQ ID NO: 181 - protein, 21 aa, Artificial Sequence
  synthetic polypeptide
GELGRLVYLLDGPGYDPIHCD

SEQ ID NO: 182 - protein, 20 aa, Artificial Sequence
  synthetic polypeptide
GELDELVYLLDGPGYDPIHS

SEQ ID NO: 183 - protein, 36 aa, Artificial Sequence
  synthetic polypeptide
RQIKIWFQNRRMKWKKGELDELVYLLDGPGYDPIHS

SEQ ID NO: 184 - protein, 595 aa, Homo sapiens [sequence omitted]

SEQ ID NO: 185 - protein, 314 aa, Artificial Sequence
  synthetic polypeptide
SAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 186 - protein, 313 aa, Artificial Sequence
  synthetic polypeptide
AGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 187 - protein, 314 aa, Artificial Sequence
  synthetic polypeptide
SAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKRMEHLYSMKCKNVVPLYDLLLEMLDAHRLHAPTSRGGASVEETDQSHLATAGSTSSHSLQKYYITGEAEGFPATV

SEQ ID NO: 188 - protein, 314 aa, Artificial Sequence
  synthetic polypeptide
SAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPGKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDLLLEAADAHRLHAPTSRGGASVEETDQSHLATAGSTSSHSLQKYYITGEAEGFPATA

SEQ ID NO: 189 - protein, 314 aa, Artificial Sequence
  synthetic polypeptide
SAGDMRAANLWPSPLMIKRSKKNSLALSLTADQMVSALLDAEPPILYSEYDPTRPFSEASMMGLLTNLADRELVHMINWAKRVPGFVDLTLHDQVHLLECAWLEILMIGLVWRSMEHPVKLLFAPNLLLDRNQGKCVEGMVEIFDMLLATSSRFRMMNLQGEEFVCLKSIILLNSGVYTFLSSTLKSLEEKDHIHRVLDKITDTLIHLMAKAGLTLQQQHQRLAQLLLILSHIRHMSNKGMEHLYSMKCKNVVPLYDAALEMLDAHRLHAPTSRGGASVEETDQSHLATAGSTSSHSLQKYYITGEAEGFPATV

SEQ ID NO: 190 - protein, 306 aa, Artificial Sequence
  synthetic polypeptide
PPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLS

SEQ ID NO: 191 - protein, 358 aa, Artificial Sequence
  synthetic polypeptide
PCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLS

SEQ ID NO: 192 - protein, 9 aa, Human immunodeficiency virus type 1
LPPLERLTL

SEQ ID NO: 193 - protein, 7 aa, Simian virus 40
PKKKRKV

SEQ ID NO: 194 - protein, 17 aa, Homo sapiens
KRVAPQKQMSIAKKKKV

SEQ ID NO: 195 - protein, 10 aa, Artificial Sequence
  synthetic polypeptide
GSGSGSSGGS

SEQ ID NO: 196 - protein, 5 aa, Artificial Sequence
  synthetic polypeptide
GGSGG

SEQ ID NO: 197 - protein, 5 aa, Artificial Sequence
  synthetic polypeptide
GGGSG

SEQ ID NO: 198 - protein, 5 aa, Artificial Sequence
  synthetic polypeptide
CVRGS

SEQ ID NO: 199 - protein, 6 aa, Artificial Sequence
  synthetic polypeptide
GGGGSG

SEQ ID NO: 200 - protein, 9 aa, Artificial Sequence
  synthetic polypeptide
GGSGSGSAC

SEQ ID NO: 201 - protein, 9 aa, Artificial Sequence
  synthetic polypeptide
LEGGGGSGG

SEQ ID NO: 202 - protein, 8 aa, Artificial Sequence
  synthetic polypeptide
GGGGSGGT

SEQ ID NO: 203 - protein, 12 aa, Artificial Sequence
  synthetic polypeptide
GSSGTGSGSGTS

SEQ ID NO: 204 - protein, 6 aa, Artificial Sequence
  synthetic polypeptide
GGSGGS

SEQ ID NO: 205 - protein, 6 aa, Artificial Sequence
  synthetic polypeptide
GSSGSS

SEQ ID NO: 206 - protein, 24 aa, Artificial Sequence
  synthetic polypeptide
GGSGGSGGSGGSGGSGGSGGSGGS

SEQ ID NO: 207 - protein, 40 aa, Artificial Sequence
  synthetic polypeptide
GGGGSGGGGSGGGGSGGGGSGGGGSGGGGSGGGGSGGGGS

SEQ ID NO: 208 - protein, 5 aa, Artificial Sequence
  synthetic polypeptide
GGGGS

SEQ ID NO: 209 - protein, 16 aa, Artificial Sequence
  synthetic polypeptide
GSGSGSGSGSGSGSGS

SEQ ID NO: 210 - protein, 5 aa, Artificial Sequence
  synthetic polypeptide
TGSQK

SEQ ID NO: 211 - protein, 21 aa, Artificial Sequence
  synthetic polypeptide
GSGEGRGSLLTCGDVEENPGP

SEQ ID NO: 212 - protein, 22 aa, Artificial Sequence
  synthetic polypeptide
GSGATNFSLLKQAGDVEENPGP

SEQ ID NO: 213 - protein, 23 aa, Artificial Sequence
  synthetic polypeptide
GSGQCTNYALLKLAGDVESNPGP

SEQ ID NO: 214 - protein, 25 aa, Artificial Sequence
  synthetic polypeptide
GSGVKQTLNFDLLKLAGDVESNPGP

SEQ ID NO: 215 - protein, 39 aa, Artificial Sequence
  synthetic polypeptide
DYKDHDGDYKDHDIDYKDDDDKMAPKKKRKVGIHGVPGG

SEQ ID NO: 216 - protein, 6 aa, Artificial Sequence
  synthetic polypeptide
DTYRYI

SEQ ID NO: 217 - protein, 9 aa, Artificial Sequence
  synthetic polypeptide
YPYDVPDYA

SEQ ID NO: 218 - protein, 8 aa, Artificial Sequence
  synthetic polypeptide
DYKDDDDK

SEQ ID NO: 219 - protein, 235 aa, Artificial Sequence
  synthetic polypeptide
VSKGEEDNMAIIKEFMRFKVHMEGSVNGHEFEIEGEGEGRPYEGTQTAKLKVTKGGPLPFAWDILSPQFMYGSKAYVKHPADIPDYLKLSFPEGFKWERVMNFEDGGVVTVTQDSSLQDGEFIYKVKLRGTNFPSDGPVMQKKTMGWQASSERMYPEDGALKGEIKQRLKLKDGGHYDAEVKTTYKAKKPVQLPGAYNVNIKLDITSHNEDYTIVEQYERAEGRHSTGGMDELYK

SEQ ID NO: 220 - protein, 335 aa, Artificial Sequence
  synthetic polypeptide
RKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 221 - DNA, 6487 bp, Artificial Sequence
  synthetic vector
cggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatg

SEQ ID NO: 222 - DNA, 8515 bp, Artificial Sequence
  synthetic vector
tggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctg

SEQ ID NO: 223 - DNA, 6754 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 224 - DNA, 8248 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 225 - DNA, 7375 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 226 - DNA, 7627 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 227 - DNA, 7591 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgccctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 228 - DNA, 7411 bp, Artificial Sequence
  synthetic vector
ggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaata

SEQ ID NO: 229 - DNA, 7900 bp, Artificial Sequence
  synthetic vector
gttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccga

SEQ ID NO: 230 - DNA, 7102 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 231 - DNA, 7918 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 232 - DNA, 7084 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 233 - DNA, 7972 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 234 - DNA, 7030 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 235 - DNA, 8188 bp, Artificial Sequence
  synthetic vector
ggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggt

SEQ ID NO: 236 - DNA, 6814 bp, Artificial Sequence
  synthetic vector
ctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatg

SEQ ID NO: 237 - DNA, 8275 bp, Artificial Sequence
  synthetic vector
cgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccgg

SEQ ID NO: 238 - DNA, 6727 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 239 - DNA, 8464 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaattccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 240 - DNA, 6538 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 241 - DNA, 8530 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 242 - DNA, 6472 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 243 - DNA, 8608 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgcctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 244 - DNA, 6394 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 245 - DNA, 8644 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 246 - DNA, 6358 bp, Artificial Sequence
  synthetic vector
cgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttat

SEQ ID NO: 247 - DNA, 8932 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 248 - DNA, 6070 bp, Artificial Sequence
  synthetic vector
gagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgacc

SEQ ID NO: 249 - DNA, 6670 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 250 - DNA, 8332 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 251 - DNA, 6763 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 252 - DNA, 8239 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 253 - DNA, 6868 bp, Artificial Sequence
  synthetic vector
ccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgata

SEQ ID NO: 254 - DNA, 8134 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 255 - DNA, 7012 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 256 - DNA, 7990 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 257 - DNA, 7174 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 258 - DNA, 7828 bp, Artificial Sequence
  synthetic vector
gtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggg

SEQ ID NO: 259 - DNA, 7243 bp, Artificial Sequence
  synthetic vector
ctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcag

SEQ ID NO: 260 - DNA, 7759 bp, Artificial Sequence
  synthetic vector
tatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtagg

SEQ ID NO: 261 - DNA, 7435 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 262 - DNA, 7567 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 263 - DNA, 7642 bp, Artificial Sequence
  synthetic vector
cgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtag

SEQ ID NO: 264 - DNA, 7360 bp, Artificial Sequence
  synthetic vector
ttgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgca

SEQ ID NO: 265 - DNA, 7744 bp, Artificial Sequence
  synthetic vector
ggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccata

SEQ ID NO: 266 - DNA, 7258 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 267 - DNA, 7951 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 268 - DNA, 7051 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 269 - DNA, 8880 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagtccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 270 - DNA, 6129 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 271 - DNA, 7467 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagtccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 272 - DNA, 7542 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 273 - DNA, 8355 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagtccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 274 - DNA, 6654 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 275 - DNA, 7623 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagtccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 276 - DNA, 7386 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgctcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 277 - DNA, 7771 bp, Artificial Sequence
  synthetic vector
ggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccata

SEQ ID NO: 278 - DNA, 7303 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 279 - DNA, 1248 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 280 - DNA, 3276 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 281 - DNA, 1515 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 282 - DNA, 3009 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 283 - DNA, 2136 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 284 - DNA, 2388 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 285 - DNA, 2352 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgccctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 286 - DNA, 2172 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 287 - DNA, 2661 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 288 - DNA, 1863 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 289 - DNA, 2679 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 290 - DNA, 1845 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 291 - DNA, 2733 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 292 - DNA, 1791 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 293 - DNA, 2949 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 294 - DNA, 1575 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 295 - DNA, 3036 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 296 - DNA, 1488 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 297 - DNA, 3225 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaattccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 298 - DNA, 1299 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 299 - DNA, 3291 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 300 - DNA, 1233 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 301 - DNA, 3369 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgcctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 302 - DNA, 1155 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 303 - DNA, 3405 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 304 - DNA, 1119 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 305 - DNA, 3693 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 306 - DNA, 831 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 307 - DNA, 1431 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 308 - DNA, 3093 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 309 - DNA, 1524 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 310 - DNA, 3000 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 311 - DNA, 1629 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 312 - DNA, 2895 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 313 - DNA, 1773 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 314 - DNA, 2751 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 315 - DNA, 1935 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 316 - DNA, 2589 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 317 - DNA, 2004 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 318 - DNA, 2520 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 319 - DNA, 2196 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 320 - DNA, 2328 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 321 - DNA, 2403 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 322 - DNA, 2121 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 323 - DNA, 2505 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 324 - DNA, 2019 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 325 - DNA, 2712 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagcccaagaaaaagcggaaggtgtga

SEQ ID NO: 326 - DNA, 1812 bp, Artificial Sequence
  synthetic polynucleotide
atggcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 327 - DNA, 3648 bp, Artificial Sequence
  synthetic polynucleotide
atgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagtccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 328 - DNA, 897 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgctcccaagaaaaagcggaaggtgtga

SEQ ID NO: 329 - DNA, 2235 bp, Artificial Sequence
  synthetic polynucleotide
atgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagtccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 330 - DNA, 2310 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgctcccaagaaaaagcggaaggtgtga

SEQ ID NO: 331 - DNA, 3123 bp, Artificial Sequence
  synthetic polynucleotide
atgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagtccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 332 - DNA, 1422 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgctcccaagaaaaagcggaaggtgtga

SEQ ID NO: 333 - DNA, 2391 bp, Artificial Sequence
  synthetic polynucleotide
atgcctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagtccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 334 - DNA, 2154 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgctcccaagaaaaagcggaaggtgtga

SEQ ID NO: 335 - DNA, 2532 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtacccctttgtatggttttacttcgatttgtggaagaagacctgagatggaagatgctgtttcgactataccaagattccttcaatcttcctctggttcgatgttagatggtcggtttgatcctcaatccgccgctcatttcttcggtgtttacgacggccatggcggttctcaggtagcgaactattgtagagagaggatgcatttggctttggcggaggagatagctaaggagaaaccgatgctctgcgatggtgatacgtggctggagaagtggaagaaagctcttttcaactcgttcctgagagttgactcggagattgggtcagttgcgccggagacggttgggtcaacgtcggtggttgccgttgttttcccgtctcacatcttcgtcgctaactgcggtgactctagagccgttctttgccgcggcaaaactgcacttccattatccgttgaccataaaccggatagagaagatgaagctgcgaggattgaagccgcaggagggaaagtgattcagtggaatggagctcgtgttttcggtgttctcgccatgtcgagatccattggcgatagatacttgaaaccatccatcattcctgatccggaagtgacggctgtgaagagagtaaaagaagatgattgtctgattttggcgagtgacggggtttgggatgtaatgacggatgaagaagcgtgtgagatggcaaggaagcggattctcttgtggcacaagaaaaacgcggtggctggggatgcatcgttgctcgcggatgagcggagaaaggaagggaaagatcctgcggcgatgtccgcggctgagtatttgtcaaagctggcgatacagagaggaagcaaagacaacataagtgtggtggtggttgatttgaaggattacaaggacgatgacgataagctagatttagctagcttaatcctctga

SEQ ID NO: 336 - DNA, 2067 bp, Artificial Sequence
  synthetic polynucleotide
atggccccaaagaagaagcggaaggtcggtatccacggagtcccagcagccgcgccaactcaagacgagttcacccaactctcccaatcaatcgccgagttccacacgtaccaactcggtaacggccgttgctcatctctcctagctcagcgaatccacgcgccgccggaaacagtatggtccgtggtgagacgtttcgataggccacagatttacaaacacttcatcaaaagctgtaacgtgagtgaagatttcgagatgcgagtgggatgcacgcgcgacgtgaacgtgataagtggattaccggcgaatacgtctcgagagagattagatctgttggacgatgatcggagagtgactgggtttagtataaccggtggtgaacataggctgaggaattataaatcggttacgacggttcatagatttgagaaagaagaagaagaagaaaggatctggaccgttgttttggaatcttatgttgttgatgtaccggaaggtaattcggaggaagatacgagattgtttgctgatacggttattagattgaatcttcagaaacttgcttcgatcactgaagctatgaactacccatacgatgttccagattacgcttccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 337 - protein, 415 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 338 - protein, 1091 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 339 - protein, 504 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 340 - protein, 1002 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 341 - protein, 711 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 342 - protein, 795 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 343 - protein, 783 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 344 - protein, 723 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 345 - protein, 886 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 346 - protein, 620 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 347 - protein, 892 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 348 - protein, 614 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 349 - protein, 910 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 350 - protein, 596 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 351 - protein, 982 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 352 - protein, 524 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 353 - protein, 1011 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 354 - protein, 495 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 355 - protein, 1074 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 356 - protein, 432 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 357 - protein, 1096 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 358 - protein, 410 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 359 - protein, 1122 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESASGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 360 - protein, 384 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTNPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 361 - protein, 1134 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 362 - protein, 372 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 363 - protein, 1230 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 364 - protein, 276 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 365 - protein, 476 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 366 - protein, 1030 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 367 - protein, 507 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 368 - protein, 999 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 369 - protein, 542 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKESGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 370 - protein, 964 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 371 - protein, 590 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 372 - protein, 916 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 373 - protein, 644 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSISGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 374 - protein, 862 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 375 - protein, 667 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 376 - protein, 839 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 377 - protein, 731 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 378 - protein, 775 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 379 - protein, 800 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 380 - protein, 706 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 381 - protein, 834 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 382 - protein, 672 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 383 - protein, 903 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKPKKKRKV

SEQ ID NO: 384 - protein, 603 aa, Artificial Sequence
  synthetic polypeptide
MAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 385 - protein, 1215 aa, Artificial Sequence
  synthetic polypeptide
MPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKSGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 386 - protein, 298 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYAPKKKRKV

SEQ ID NO: 387 - protein, 744 aa, Artificial Sequence
  synthetic polypeptide
MPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKSGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 388 - protein, 769 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYAPKKKRKV

SEQ ID NO: 389 - protein, 1040 aa, Artificial Sequence
  synthetic polypeptide
MPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKSGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 390 - protein, 473 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYAPKKKRKV

SEQ ID NO: 391 - protein, 796 aa, Artificial Sequence
  synthetic polypeptide
MPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKSGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 392 - protein, 717 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYAPKKKRKV

SEQ ID NO: 393 - protein, 843 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTPLYGFTSICGRRPEMEDAVSTIPRFLQSSSGSMLDGRFDPQSAAHFFGVYDGHGGSQVANYCRERMHLALAEEIAKEKPMLCDGDTWLEKWKKALFNSFLRVDSEIGSVAPETVGSTSVVAVVFPSHIFVANCGDSRAVLCRGKTALPLSVDHKPDREDEAARIEAAGGKVIQWNGARVFGVLAMSRSIGDRYLKPSIIPDPEVTAVKRVKEDDCLILASDGVWDVMTDEEACEMARKRILLWHKKNAVAGDASLLADERRKEGKDPAAMSAAEYLSKLAIQRGSKDNISVVVVDLKDYKDDDDKLDLASLIL

SEQ ID NO: 394 - protein, 688 aa, Artificial Sequence
  synthetic polypeptide
MAPKKKRKVGIHGVPAAAPTQDEFTQLSQSIAEFHTYQLGNGRCSSLLAQRIHAPPETVWSVVRRFDRPQIYKHFIKSCNVSEDFEMRVGCTRDVNVISGLPANTSRERLDLLDDDRRVTGFSITGGEHRLRNYKSVTTVHRFEKEEEEERIWTVVLESYVVDVPEGNSEEDTRLFADTVIRLNLQKLASITEAMNYPYDVPDYASGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 395 - DNA, 5848 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 396 - DNA, 8278 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 397 - DNA, 6115 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 398 - DNA, 8011 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 399 - DNA, 6736 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 400 - DNA, 7390 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 401 - DNA, 6952 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgccctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 402 - DNA, 7174 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 403 - DNA, 7261 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 404 - DNA, 6865 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 405 - DNA, 7279 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 406 - DNA, 6847 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 407 - DNA, 7333 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 408 - DNA, 6793 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 409 - DNA, 7549 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 410 - DNA, 6577 bp, Artificial Sequence
  synthetic vector
atgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccggg

SEQ ID NO: 411 - DNA, 7636 bp, Artificial Sequence
  synthetic vector
gcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtg

SEQ ID NO: 412 - DNA, 6490 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 413 - DNA, 7825 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaattccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 414 - DNA, 6301 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 415 - DNA, 7891 bp, Artificial Sequence
  synthetic vector
gagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgacc

SEQ ID NO: 416 - DNA, 6235 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 417 - DNA, 7969 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgcctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 418 - DNA, 6157 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 419 - DNA, 8005 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 420 - DNA, 6121 bp, Artificial Sequence
  synthetic vector
cgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccag

SEQ ID NO: 421 - DNA, 8293 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 422 - DNA, 5833 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 423 - DNA, 6031 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 424 - DNA, 8095 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 425 - DNA, 6124 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 426 - DNA, 8002 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 427 - DNA, 6229 bp, Artificial Sequence
  synthetic vector
ccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgata

SEQ ID NO: 428 - DNA, 7897 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 429 - DNA, 6373 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 430 - DNA, 7753 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 431 - DNA, 6535 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 432 - DNA, 7591 bp, Artificial Sequence
  synthetic vector
gtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggg

SEQ ID NO: 433 - DNA, 6604 bp, Artificial Sequence
  synthetic vector
ctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcag

SEQ ID NO: 434 - DNA, 7522 bp, Artificial Sequence
  synthetic vector
tatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtagg

SEQ ID NO: 435 - DNA, 6796 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 436 - DNA, 7330 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 437 - DNA, 7003 bp, Artificial Sequence
  synthetic vector
cgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtag

SEQ ID NO: 438 - DNA, 7123 bp, Artificial Sequence
  synthetic vector
ttgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgca

SEQ ID NO: 439 - DNA, 7105 bp, Artificial Sequence
  synthetic vector
ggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccata

SEQ ID NO: 440 - DNA, 7021 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 441 - DNA, 7312 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 442 - DNA, 6814 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 443 - DNA, 7747 bp, Artificial Sequence
  synthetic vector
cctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaa

SEQ ID NO: 444 - DNA, 6379 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 445 - DNA, 7849 bp, Artificial Sequence
  synthetic vector
ataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggatccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatg

SEQ ID NO: 446 - DNA, 6277 bp, Artificial Sequence
  synthetic vector
attgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccttcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaa

SEQ ID NO: 447 - DNA, 8128 bp, Artificial Sequence
  synthetic vector
gataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaatttccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaat

SEQ ID NO: 448 - DNA, 5998 bp, Artificial Sequence
  synthetic vector
gaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtca

SEQ ID NO: 449 - DNA, 8215 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgcctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 450 - DNA, 5911 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 451 - DNA, 7264 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcatgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 452 - DNA, 6910 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 453 - DNA, 7288 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcactagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 454 - DNA, 6928 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagcctctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 455 - DNA, 609 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 456 - DNA, 3039 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 457 - DNA, 876 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 458 - DNA, 2772 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 459 - DNA, 1497 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 460 - DNA, 2151 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 461 - DNA, 1713 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgccctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 462 - DNA, 1935 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 463 - DNA, 2022 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 464 - DNA, 1626 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 465 - DNA, 2040 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 466 - DNA, 1608 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 467 - DNA, 2094 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 468 - DNA, 1554 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 469 - DNA, 2310 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 470 - DNA, 1338 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 471 - DNA, 2397 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 472 - DNA, 1251 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 473 - DNA, 2586 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaattccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 474 - DNA, 1062 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 475 - DNA, 2652 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 476 - DNA, 996 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 477 - DNA, 2730 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgcctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 478 - DNA, 918 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 479 - DNA, 2766 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 480 - DNA, 882 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 481 - DNA, 3054 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 482 - DNA, 594 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 483 - DNA, 792 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 484 - DNA, 2856 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 485 - DNA, 885 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 486 - DNA, 2763 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 487 - DNA, 990 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 488 - DNA, 2658 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 489 - DNA, 1134 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 490 - DNA, 2514 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 491 - DNA, 1296 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 492 - DNA, 2352 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 493 - DNA, 1365 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 494 - DNA, 2283 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 495 - DNA, 1557 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 496 - DNA, 2091 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 497 - DNA, 1764 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 498 - DNA, 1884 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 499 - DNA, 1866 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 500 - DNA, 1782 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 501 - DNA, 2073 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 502 - DNA, 1575 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 503 - DNA, 2508 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 504 - DNA, 1140 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 505 - DNA, 2610 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggatccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 506 - DNA, 1038 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccttcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 507 - DNA, 2889 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaatttccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 508 - DNA, 759 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 509 - DNA, 2976 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgcctccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcacccaagaaaaagcggaaggtgtga

SEQ ID NO: 510 - DNA, 672 bp, Artificial Sequence
  synthetic polynucleotide
atgtctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtaccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 511 - DNA, 2025 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcatga

SEQ ID NO: 512 - DNA, 1674 bp, Artificial Sequence
  synthetic polynucleotide
atggccccaaagaagaagcggaaggtcggtatccacggagtcccagcagcctctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 513 - DNA, 2049 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatcctctggcatgagatgtggcatgaaggcctggaagaggcatctcgtttgtactttggggaaaggaacgtgaaaggcatgtttgaggtgctggagcccttgcatgctatgatggaacggggcccccagactctgaaggaaacatcctttaatcaggcctatggtcgagatttaatggaggcccaagagtggtgcaggaagtacatgaaatcagggaatgtcaaggacctcctccaagcctgggacctctattatcatgtgttccgacgaatctcactagatttagctagcttaatcctctga

SEQ ID NO: 514 - DNA, 1692 bp, Artificial Sequence
  synthetic polynucleotide
atggccccaaagaagaagcggaaggtcggtatccacggagtcccagcagcctctagaggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtga

SEQ ID NO: 515 - protein, 202 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 516 - protein, 1012 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 517 - protein, 291 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 518 - protein, 923 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 519 - protein, 498 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 520 - protein, 716 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 521 - protein, 570 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 522 - protein, 644 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 523 - protein, 673 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 524 - protein, 541 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 525 - protein, 679 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 526 - protein, 535 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 527 - protein, 697 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 528 - protein, 517 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 529 - protein, 769 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 530 - protein, 445 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 531 - protein, 798 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 532 - protein, 416 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 533 - protein, 861 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 534 - protein, 353 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 535 - protein, 883 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 536 - protein, 331 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 537 - protein, 909 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESASGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 538 - protein, 305 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTNPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 539 - protein, 921 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 540 - protein, 293 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 541 - protein, 1017 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 542 - protein, 197 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 543 - protein, 263 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 544 - protein, 951 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 545 - protein, 294 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 546 - protein, 920 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 547 - protein, 329 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKESGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 548 - protein, 885 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 549 - protein, 377 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 550 - protein, 837 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 551 - protein, 431 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSISGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 552 - protein, 783 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 553 - protein, 454 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 554 - protein, 760 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 555 - protein, 518 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 556 - protein, 696 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 557 - protein, 587 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 558 - protein, 627 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 559 - protein, 621 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 560 - protein, 593 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 561 - protein, 690 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 562 - protein, 524 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 563 - protein, 835 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNISGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 564 - protein, 379 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTNARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 565 - protein, 869 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 566 - protein, 345 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 567 - protein, 962 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRISGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 568 - protein, 252 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 569 - protein, 991 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIASGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISPKKKRKV

SEQ ID NO: 570 - protein, 223 aa, Artificial Sequence
  synthetic polypeptide
MSRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 571 - protein, 674 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRIS

SEQ ID NO: 572 - protein, 557 aa, Artificial Sequence
  synthetic polypeptide
MAPKKKRKVGIHGVPAASRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 573 - protein, 682 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTILWHEMWHEGLEEASRLYFGERNVKGMFEVLEPLHAMMERGPQTLKETSFNQAYGRDLMEAQEWCRKYMKSGNVKDLLQAWDLYYHVFRRISLDLASLIL

SEQ ID NO: 574 - protein, 563 aa, Artificial Sequence
  synthetic polypeptide
MAPKKKRKVGIHGVPAASRGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLESGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSKRPAATKKAGQAKKKK

SEQ ID NO: 575 - DNA, 6607 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 576 - DNA, 8224 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 577 - DNA, 6874 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 578 - DNA, 7957 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 579 - DNA, 7495 bp, Artificial Sequence
  synthetic vector
tgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgc

SEQ ID NO: 580 - DNA, 7336 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 581 - DNA, 7711 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgccctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 582 - DNA, 7120 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 583 - DNA, 8020 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 584 - DNA, 6811 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 585 - DNA, 8038 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 586 - DNA, 6793 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 587 - DNA, 8092 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 588 - DNA, 6739 bp, Artificial Sequence
  synthetic vector
tgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagt

SEQ ID NO: 589 - DNA, 8308 bp, Artificial Sequence
  synthetic vector
ggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggc

SEQ ID NO: 590 - DNA, 6523 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 591 - DNA, 8395 bp, Artificial Sequence
  synthetic vector
tgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaat

SEQ ID NO: 592 - DNA, 6436 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 593 - DNA, 8584 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaattccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 594 - DNA, 6247 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 595 - DNA, 8650 bp, Artificial Sequence
  synthetic vector
ttcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcgga

SEQ ID NO: 596 - DNA, 6181 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 597 - DNA, 8728 bp, Artificial Sequence
  synthetic vector
ttcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgcctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcaga

SEQ ID NO: 598 - DNA, 6103 bp, Artificial Sequence
  synthetic vector
attgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaa

SEQ ID NO: 599 - DNA, 8764 bp, Artificial Sequence
  synthetic vector
ggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgt

SEQ ID NO: 600 - DNA, 6067 bp, Artificial Sequence
  synthetic vector
gaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtca

SEQ ID NO: 601 - DNA, 9052 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 602 - DNA, 5779 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 603 - DNA, 6790 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 604 - DNA, 8041 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 605 - DNA, 6883 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 606 - DNA, 7948 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 607 - DNA, 6988 bp, Artificial Sequence
  synthetic vector
tgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgc

SEQ ID NO: 608 - DNA, 7843 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 609 - DNA, 7132 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 610 - DNA, 7699 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 611 - DNA, 7294 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 612 - DNA, 7537 bp, Artificial Sequence
  synthetic vector
gtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggg

SEQ ID NO: 613 - DNA, 7363 bp, Artificial Sequence
  synthetic vector
cttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgct

SEQ ID NO: 614 - DNA, 7468 bp, Artificial Sequence
  synthetic vector
tatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtagg

SEQ ID NO: 615 - DNA, 7555 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 616 - DNA, 7276 bp, Artificial Sequence
  synthetic vector
gaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaac

SEQ ID NO: 617 - DNA, 7762 bp, Artificial Sequence
  synthetic vector
cggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcggggggga

SEQ ID NO: 618 - DNA, 7069 bp, Artificial Sequence
  synthetic vector
tgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctc

SEQ ID NO: 619 - DNA, 7864 bp, Artificial Sequence
  synthetic vector
tgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctgg

SEQ ID NO: 620 - DNA, 6967 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 621 - DNA, 8071 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 622 - DNA, 6760 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 623 - DNA, 8506 bp, Artificial Sequence
  synthetic vector
cctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaa

SEQ ID NO: 624 - DNA, 6325 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 625 - DNA, 8608 bp, Artificial Sequence
  synthetic vector
gcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctag

SEQ ID NO: 626 - DNA, 6223 bp, Artificial Sequence
  synthetic vector
attgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccttcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaa

SEQ ID NO: 627 - DNA, 8887 bp, Artificial Sequence
  synthetic vector
ggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaatttccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgt

SEQ ID NO: 628 - DNA, 5944 bp, Artificial Sequence
  synthetic vector
gaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtca

SEQ ID NO: 629 - DNA, 8974 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgcctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 630 - DNA, 5857 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 631 - DNA, 6610 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 632 - DNA, 8269 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 633 - DNA, 6634 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 634 - DNA, 8287 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 635 - DNA, 8023 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 636 - DNA, 6856 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 637 - DNA, 8047 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 638 - DNA, 6874 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 639 - DNA, 8041 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 640 - DNA, 6841 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 641 - DNA, 8065 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 642 - DNA, 6856 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 643 - DNA, 8311 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 644 - DNA, 6568 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 645 - DNA, 8335 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 646 - DNA, 6586 bp, Artificial Sequence
  synthetic vector
tggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcagcccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggaaaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccaccatggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgc

SEQ ID NO: 647 - DNA, 8997 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 648 - DNA, 5841 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 649 - DNA, 7584 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 650 - DNA, 7254 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 651 - DNA, 8472 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 652 - DNA, 6366 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 653 - DNA, 7740 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 654 - DNA, 7098 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaaccccaagaaaaagcggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

SEQ ID NO: 655 - DNA, 1368 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 656 - DNA, 2985 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 657 - DNA, 1635 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgcttccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 658 - DNA, 2718 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 659 - DNA, 2256 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 660 - DNA, 2097 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 661 - DNA, 2472 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgccctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 662 - DNA, 1881 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 663 - DNA, 2781 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 664 - DNA, 1572 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 665 - DNA, 2799 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 666 - DNA, 1554 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 667 - DNA, 2853 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 668 - DNA, 1500 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 669 - DNA, 3069 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 670 - DNA, 1284 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 671 - DNA, 3156 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 672 - DNA, 1197 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 673 - DNA, 3345 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaattccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 674 - DNA, 1008 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 675 - DNA, 3411 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaacttccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 676 - DNA, 942 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 677 - DNA, 3489 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgcctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 678 - DNA, 864 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 679 - DNA, 3525 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 680 - DNA, 828 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 681 - DNA, 3813 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 682 - DNA, 540 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 683 - DNA, 1551 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 684 - DNA, 2802 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 685 - DNA, 1644 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaattccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 686 - DNA, 2709 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 687 - DNA, 1749 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 688 - DNA, 2604 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 689 - DNA, 1893 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 690 - DNA, 2460 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 691 - DNA, 2055 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcatttccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 692 - DNA, 2298 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 693 - DNA, 2124 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggattccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 694 - DNA, 2229 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 695 - DNA, 2316 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctcctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 696 - DNA, 2037 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 697 - DNA, 2523 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 698 - DNA, 1830 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 699 - DNA, 2625 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 700 - DNA, 1728 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 701 - DNA, 2832 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaactccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 702 - DNA, 1521 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 703 - DNA, 3267 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 704 - DNA, 1086 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 705 - DNA, 3369 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 706 - DNA, 984 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccttcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 707 - DNA, 3648 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaatttccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 708 - DNA, 705 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 709 - DNA, 3735 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgcctccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgccccaagaaaaagcggaaggtgtga

SEQ ID NO: 710 - DNA, 618 bp, Artificial Sequence
  synthetic polynucleotide
atgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 711 - DNA, 1371 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctga

SEQ ID NO: 712 - DNA, 3033 bp, Artificial Sequence
  synthetic polynucleotide
atggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 713 - DNA, 1395 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 714 - DNA, 3051 bp, Artificial Sequence
  synthetic polynucleotide
atggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtga

SEQ ID NO: 715 - DNA, 2784 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctga

SEQ ID NO: 716 - DNA, 1620 bp, Artificial Sequence
  synthetic polynucleotide
atggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 717 - DNA, 2808 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 718 - DNA, 1638 bp, Artificial Sequence
  synthetic polynucleotide
atggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtga

SEQ ID NO: 719 - DNA, 2802 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctga

SEQ ID NO: 720 - DNA, 1605 bp, Artificial Sequence
  synthetic polynucleotide
atggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattcctccggatccggacctaagaaaaagaggaaggtgtga

SEQ ID NO: 721 - DNA, 2826 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 722 - DNA, 1620 bp, Artificial Sequence
  synthetic polynucleotide
atggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtga

SEQ ID NO: 723 - DNA, 3072 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctga

SEQ ID NO: 724 - DNA, 1332 bp, Artificial Sequence
  synthetic polynucleotide
atggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtga

SEQ ID NO: 725 - DNA, 3096 bp, Artificial Sequence
  synthetic polynucleotide
atgctagatttagctagcttaatcctcatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaagtccggagggtctggctccggatcaagtggtggcagcggtaccatggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgcctagatttagctagcttaatcctctga

SEQ ID NO: 726 - DNA, 1350 bp, Artificial Sequence
  synthetic polynucleotide
atggccccaaagaagaagcggaaggtcggtatccacggagtcccagcagccaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaactccggagggtctggctccggatcaagtggtggcagcggtaccgataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccaaaaggccggcggccacgaaaaaggccggccaggcaaaaaagaaaaagtga

SEQ ID NO: 727 - DNA, 3765 bp, Artificial Sequence
  synthetic polynucleotide
atggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 728 - DNA, 609 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacatccggagggtctggctccggatcaagtggtggcagcggtaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaaccccaagaaaaagcggaaggtgtga

SEQ ID NO: 729 - DNA, 2352 bp, Artificial Sequence
  synthetic polynucleotide
atggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctccggagggtctggctccggatcaagtggtggcagcggtacctcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 730 - DNA, 2022 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtccggagggtctggctccggatcaagtggtggcagcggtaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaaccccaagaaaaagcggaaggtgtga

SEQ ID NO: 731 - DNA, 3240 bp, Artificial Sequence
  synthetic polynucleotide
atggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctccggagggtctggctccggatcaagtggtggcagcggtaccgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 732 - DNA, 1134 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctctccggagggtctggctccggatcaagtggtggcagcggtaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaaccccaagaaaaagcggaaggtgtga

SEQ ID NO: 733 - DNA, 2508 bp, Artificial Sequence
  synthetic polynucleotide
atggccgccagcgacgaagtgaacctgatcgagagcagaaccgtggtgcccctgaacacctgggtgctgatctccaacttcaaggtggcctacaacatcctgcggaggcccgacggcaccttcaacagacacctggccgagtacctggaccggaaagtgaccgccaacgccaaccctgtggacggcgtgttcagcttcgacgtgctgatcgaccggcggatcaacctgctgagccgggtgtacagacccgcctacgccgatcaggaacagcccccctctatcctggatctggaaaagcccgtggatggcgacatcgtgcccgtgatcctgttcttccacggcggcagctttgcccacagcagcgccaatagcgccatctacgacaccctgtgcagacggctcgtgggcctgtgcaaatgcgtggtggtgtccgtgaactaccgcagagcccccgagaacccttacccctgcgcctacgatgatggctggatcgccctgaactgggtcaacagcagaagctggctgaagtccaagaaagacagcaaggtgcacatctttctggccggcgatagcagcggcggcaatatcgcccataacgtggccctgagagccggcgagtctggcatcgatgtgctgggcaatatcctgctgaaccccatgttcggcggcaacgagcggaccgagagcgagaagtctctggacggcaagtacttcgtgaccgtgcgggaccgggactggtactggaaggcctttctgcccgagggcgaggacagagagcaccccgcctgcaatcccttcagccccagaggcaaaagcctggaaggcgtgtccttcccaaagtccctggtggtggtggccggcctggacctgatcagagattggcagctggcctatgccgagggcctgaagaaagccggccaggaagtgaagctgatgcacctggaaaaggccaccgtgggcttctacctgctgcccaacaacaaccacttccacaacgtgatggacgagatcagcgccttcgtgaacgccgagtgctccggagggtctggctccggatcaagtggtggcagcggtaccgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgcccaagaaaaagcggaaggtgtga

SEQ ID NO: 734 - DNA, 1866 bp, Artificial Sequence
  synthetic polynucleotide
atgatcgaaaaaaaaaagtccttcgccaagggcatgggcgtgaagtccacactcgtgtccggctccaaagtgtacatgacaaccttcgccgaaggcagcgacgccaggctggaaaagatcgtggagggcgacagcatcaggagcgtgaatgagggcgaggccttcagcgctgaaatggccgataaaaacgccggctataagatcggcaacgccaaattcagccatcctaagggctacgccgtggtggctaacaaccctctgtatacaggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaactccggagggtctggctccggatcaagtggtggcagcggtaccatgaagcgggaccaccaccatcaccatcatcaggacaagaaaaccatgatgatgaacgaagaggacgacggcaacggcatggacgagctgctggctgtgctgggctacaaagtgcggagcagcgagatggccgacgtggcccagaaactggaacagctggaagtgatgatgagcaacgtgcaggaagatgacctgtcccagctggccaccgagacagtgcactacaaccccgccgagctgtacacctggctggactccatgctgaccgacctgaaccccaagaaaaagcggaaggtgtga

SEQ ID NO: 735 - protein, 455 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 736 - protein, 994 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 737 - protein, 544 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAASGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 738 - protein, 905 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 739 - protein, 751 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 740 - protein, 698 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 741 - protein, 823 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 742 - protein, 626 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 743 - protein, 926 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 744 - protein, 523 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 745 - protein, 932 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 746 - protein, 517 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 747 - protein, 950 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 748 - protein, 499 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 749 - protein, 1022 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 750 - protein, 427 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 751 - protein, 1051 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 752 - protein, 398 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 753 - protein, 1114 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 754 - protein, 335 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 755 - protein, 1136 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 756 - protein, 313 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 757 - protein, 1162 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESASGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 758 - protein, 287 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTNPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 759 - protein, 1174 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 760 - protein, 275 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 761 - protein, 1270 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 762 - protein, 179 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTGKVSEYFDAVNDEKKYNDRLLKLLCVPFGYCIPRFKNLSIEALFDRNEAAKFDKEKKKVSGNSGSGPKKKRKV

SEQ ID NO: 763 - protein, 516 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 764 - protein, 933 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 765 - protein, 547 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 766 - protein, 902 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 767 - protein, 582 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKESGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 768 - protein, 867 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 769 - protein, 630 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 770 - protein, 819 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 771 - protein, 684 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSISGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 772 - protein, 765 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 773 - protein, 707 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 774 - protein, 742 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 775 - protein, 771 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 776 - protein, 678 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 777 - protein, 840 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 778 - protein, 609 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 779 - protein, 874 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 780 - protein, 575 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 781 - protein, 943 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 782 - protein, 506 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 783 - protein, 1088 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNISGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 784 - protein, 361 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTNARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 785 - protein, 1122 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 786 - protein, 327 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 787 - protein, 1215 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRISGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 788 - protein, 234 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 789 - protein, 1244 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIASGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECPKKKRKV

SEQ ID NO: 790 - protein, 205 aa, Artificial Sequence
  synthetic polypeptide
MKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 791 - protein, 456 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 792 - protein, 1010 aa, Artificial Sequence
  synthetic polypeptide
MAPKKKRKVGIHGVPAAKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 793 - protein, 464 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 794 - protein, 1016 aa, Artificial Sequence
  synthetic polypeptide
MAPKKKRKVGIHGVPAAKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSKRPAATKKAGQAKKKK

SEQ ID NO: 795 - protein, 927 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 796 - protein, 539 aa, Artificial Sequence
  synthetic polypeptide
MAPKKKRKVGIHGVPAAKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 797 - protein, 935 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 798 - protein, 545 aa, Artificial Sequence
  synthetic polypeptide
MAPKKKRKVGIHGVPAAKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSKRPAATKKAGQAKKKK

SEQ ID NO: 799 - protein, 933 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 800 - protein, 534 aa, Artificial Sequence
  synthetic polypeptide
MAPKKKRKVGIHGVPAAKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSSGSGPKKKRKV

SEQ ID NO: 801 - protein, 941 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 802 - protein, 539 aa, Artificial Sequence
  synthetic polypeptide
MAPKKKRKVGIHGVPAAKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSKRPAATKKAGQAKKKK

SEQ ID NO: 803 - protein, 1023 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAEC

SEQ ID NO: 804 - protein, 443 aa, Artificial Sequence
  synthetic polypeptide
MAPKKKRKVGIHGVPAAKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKV

SEQ ID NO: 805 - protein, 1031 aa, Artificial Sequence
  synthetic polypeptide
MLDLASLILIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKSGGSGSGSSGGSGTMAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECLDLASLIL

SEQ ID NO: 806 - protein, 449 aa, Artificial Sequence
  synthetic polypeptide
MAPKKKRKVGIHGVPAAKRDHHHHHHQDKKTMMMNEEDDGNGMDELLAVLGYKVRSSEMADVAQKLEQLEVMMSNVQEDDLSQLATETVHYNPAELYTWLDSMLTDLNSGGSGSGSSGGSGTDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSKRPAATKKAGQAKKKK

SEQ ID NO: 807 - protein, 1254 aa, Artificial Sequence
  synthetic polypeptide
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECSGGSGSGSSGGSGTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 808 - protein, 202 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTSGGSGSGSSGGSGTMKRDHHHHHHQDKKTMMMNEEDDGNGMDELLAVLGYKVRSSEMADVAQKLEQLEVMMSNVQEDDLSQLATETVHYNPAELYTWLDSMLTDLNPKKKRKV

SEQ ID NO: 809 - protein, 783 aa, Artificial Sequence
  synthetic polypeptide
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECSGGSGSGSSGGSGTSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 810 - protein, 673 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSGGSGSGSSGGSGTMKRDHHHHHHQDKKTMMMNEEDDGNGMDELLAVLGYKVRSSEMADVAQKLEQLEVMMSNVQEDDLSQLATETVHYNPAELYTWLDSMLTDLNPKKKRKV

SEQ ID NO: 811 - protein, 1079 aa, Artificial Sequence
  synthetic polypeptide
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECSGGSGSGSSGGSGTDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 812 - protein, 377 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLSGGSGSGSSGGSGTMKRDHHHHHHQDKKTMMMNEEDDGNGMDELLAVLGYKVRSSEMADVAQKLEQLEVMMSNVQEDDLSQLATETVHYNPAELYTWLDSMLTDLNPKKKRKV

SEQ ID NO: 813 - protein, 835 aa, Artificial Sequence
  synthetic polypeptide
MAASDEVNLIESRTVVPLNTWVLISNFKVAYNILRRPDGTFNRHLAEYLDRKVTANANPVDGVFSFDVLIDRRINLLSRVYRPAYADQEQPPSILDLEKPVDGDIVPVILFFHGGSFAHSSANSAIYDTLCRRLVGLCKCVVVSVNYRRAPENPYPCAYDDGWIALNWVNSRSWLKSKKDSKVHIFLAGDSSGGNIAHNVALRAGESGIDVLGNILLNPMFGGNERTESEKSLDGKYFVTVRDRDWYWKAFLPEGEDREHPACNPFSPRGKSLEGVSFPKSLVVVAGLDLIRDWQLAYAEGLKKAGQEVKLMHLEKATVGFYLLPNNNHFHNVMDEISAFVNAECSGGSGSGSSGGSGTAKFVEEYAFFKDSAKIADELRLIKSFARMGEPIADARRAMYIDAIRILGTNLSYDELKALADTFSLDENGNKLKKGKHGMRNFIINNVISNKRFHYLIRYGDPAHLHEIAKNEAVVKFVLGRIADIQKKQGQNGKNQIDRYYETCIGKDKGKSVSEKVDALTKIITGMNYDQFDKKRSVIEDTGRENAEREKFKKIISLYLTVIYHILKNIVNINARYVIGFHCVERDAQLYKEKGYDINLKKLEEKGFSSVTKLCAGIDETAPDKRKDVEKEMAERAKESIDSLESANPKLYANYIKYSDEKKAEEFTRQINREKAKTALNAYLRNTKWNVIIREDLLRIDNKTCTLFRNKAVHLEVARYVHAYINDIAEVNSYFQLYHYIMQRIIMNERYEKSSGKVSEYFDAVNDEKKYNDRLLKLLCVPFGYCIPRFKNLSIEALFDRNEAAKFDKEKKKVSGNSGSGPKKKRKVPKKKRKV

SEQ ID NO: 814 - protein, 621 aa, Artificial Sequence
  synthetic polypeptide
MIEKKKSFAKGMGVKSTLVSGSKVYMTTFAEGSDARLEKIVEGDSIRSVNEGEAFSAEMADKNAGYKIGNAKFSHPKGYAVVANNPLYTGPVQQDMLGLKETLEKRYFGESADGNDNICIQVIHNILDIEKILAEYITNAAYAVNNISGLDKDIIGFGKFSTVYTYDEFKDPEHHRAAFNNNDKLINAIKAQYDEFDNFLDNPRLGYFGQAFFSKEGRNYIINYGNECYDILALLSGLRHWVVHNNEEESRISRTWLYNLDKNLDNEYISTLNYLYDRITNELTNSFSKNSAANVNYIAETLGINPAEFAEQYFRFSIMKEQKNLGFNITKLREVMLDRKDMSEIRKNHKVFDSIRTKVYTMMDFVIYRYYIEEDAKVAAANKSLPDNEKSLSEKDIFVINLRGSFNDDQKDALYYDEANRIWRKLENIMHNIKEFRGNKTREYKKKDAPRLPRILPAGRDVSAFSKLMYALTMFLDGKEINDLLTTLINKFDNIQSFLKVMPLIGVNSGGSGSGSSGGSGTMKRDHHHHHHQDKKTMMMNEEDDGNGMDELLAVLGYKVRSSEMADVAQKLEQLEVMMSNVQEDDLSQLATETVHYNPAELYTWLDSMLTDLNPKKKRKV

SEQ ID NO: 815 - DNA, 8394 bp, Artificial Sequence
  synthetic vector
cccaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcggatccgcatctcaattagtcagcaaccatagtcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagctaacttgtttattgcagcttataatggttacaaataaagcaatagcatcacaaatttcacaaataaagcatttttttcactgcattctagttgtggtttgtccaaactcatcaatgtatcttatcatgtctggatccgctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgggtcgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattgattaattcgagcgaaggcgcgcccattactcgcatccattctcaggctgtctcgtctcgtctcgcacgcgtgccgccaccatgcatactctttatgcccccggtggatatgacattatgggatatctggaccagatcggcaaccggccaaacccgcaggtggaactgggccccgtggatacatcctgcgccttgattctttgtgacctgaaacagaaagacaccccgatagtttacgcgagtgaagccttcctctacatgacaggttacagcaacgcagaggtgctgggccggaattgccggtttctgcaaagccctgacggcatggtgaagcccaagagcacccggaagtacgtggatagtaacacaatcaatactatgcgcaaggcaatcgacaggaatgccgaggtgcaggttgaagtagtcaattttaaaaagaatggacagcgatttgttaatttcctgactatgatacctgttagggacgaaacaggcgagtatcgatactctatgggattccagtgcgaaacagaatccggagggtctggctccggatcaagtggtggcagcggtaccggacccgtccagcaggatatgctcggcctgaaggaaactctggaaaagaggtacttcggcgagagcgctgatggcaatgacaatatttgtatccaggtgatccataacatcctggacattgaaaaaatcctcgccgaatacattaccaacgccgcctacgccgtcaacaatatctccggcctggataaggacattattggattcggcaagttctccacagtgtatacctacgacgaattcaaagaccccgagcaccatagggccgctttcaacaataacgataagctcatcaacgccatcaaggcccagtatgacgagttcgacaacttcctcgataaccccagactcggctatttcggccaggcctttttcagcaaggagggcagaaattacatcatcaattacggcaacgaatgctatgacattctggccctcctgagcggactgaggcactgggtggtccataacaacgaagaagagtccaggatctccaggacctggctctacaacctcgataagaacctcgacaacgaatacatctccaccctcaactacctctacgacaggatcaccaatgagctgaccaactccttctccaagaactccgccgccaacgtgaactatattgccgaaactctgggaatcaaccctgccgaattcgccgaacaatatttcagattcagcattatgaaagagcagaaaaacctcggattcaatatcaccaagctcagggaagtgatgctggacaggaaggatatgtccgagatcaggaaaaatcataaggtgttcgactccatcaggaccaaggtctacaccatgatggactttgtgatttataggtattacatcgaagaggatgccaaggtggctgccgccaataagtccctccccgataatgagaagtccctgagcgagaaggatatctttgtgattaacctgaggggctccttcaacgacgaccagaaggatgccctctactacgatgaagctaatagaatttggagaaagctcgaaaatatcatgcacaacatcaaggaatttaggggaaacaagacaagagagtataagaagaaggacgcccctagactgcccagaatcctgcccgctggccgtgatgtttccgccttcagcaaactcatgtatgccctgaccatgttcctggatggcaaggagatcaacgacctcctgaccaccctgattaataaattcgataacatccagagcttcctgaaggtgatgcctctcatcggagtcaacgctaagttcgtggaggaatacgcctttttcaaagactccgccaagatcgccgatgagctgaggctgatcaagtccttcgctagaatgggagaacctattgccgatgccaggagggccatgtatatcgacgccatccgtattttaggaaccaacctgtcctatgatgagctcaaggccctcgccgacaccttttccctggacgagaacggaaacaagctcaagaaaggcaagcacggcatgagaaatttcattattaataacgtgatcagcaataaaaggttccactacctgatcagatacggtgatcctgcccacctccatgagatcgccaaaaacgaggccgtggtgaagttcgtgctcggcaggatcgctgacatccagaaaaaacagggccagaacggcaagaaccagatcgacaggtactacgaaacttgtatcggaaaggataagggcaagagcgtgagcgaaaaggtggacgctctcacaaagatcatcaccggaatgaactacgaccaattcgacaagaaaaggagcgtcattgaggacaccggcagggaaaacgccgagagggagaagtttaaaaagatcatcagcctgtacctcaccgtgatctaccacatcctcaagaatattgtcaatatcaacgccaggtacgtcatcggattccattgcgtcgagcgtgatgctcaactgtacaaggagaaaggctacgacatcaatctcaagaaactggaagagaagggattcagctccgtcaccaagctctgcgctggcattgatgaaactgcccccgataagagaaaggacgtggaaaaggagatggctgaaagagccaaggagagcattgacagcctcgagagcgccaaccccaagctgtatgccaattacatcaaatacagcgacgagaagaaagccgaggagttcaccaggcagattaacagggagaaggccaaaaccgccctgaacgcctacctgaggaacaccaagtggaatgtgatcatcagggaggacctcctgagaattgacaacaagacatgtaccctgttcagaaacaaggccgtccacctggaagtggccaggtatgtccacgcctatatcaacgacattgccgaggtcaattcctacttccaactgtaccattacatcatgcagagaattatcatgaatgagaggtacgagaaaagcagcggaaaggtgtccgagtacttcgacgctgtgaatgacgagaagaagtacaacgataggctcctgaaactgctgtgtgtgcctttcggctactgtatccccaggtttaagaacctgagcatcgaggccctgttcgataggaacgaggccgccaagttcgacaaggagaaaaagaaggtgtccggcaattccggatccggacctaagaaaaagaggaaggtgtgagaattcctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcgtgtaccgctgggagttcgtagacggaaacaaacgcagaatccaagcgcggccgcccaggatacatagattaccacaactccgagcccttccaccgctagcgcactcctcaggtgcaggctgcctatcagaaggtggtggctggtgtggccaatgccctggctcacaaataccactgagatctttttccctctgccaaaaattatggggacatcatgaagccccttgagcatctgacttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatccctcgacctgcag

(The sequence listing continues in the following parts.)

---

What is claimed herein is:

1. An inducible split-nuclease polypeptide system comprising:
   a) a first polypeptide comprising:
      i) a first member of an inducible dimerization domain ($D^1$); and
      ii) a first polypeptide fragment of a sequence-specific nuclease ($N^1$); and
   b) a second polypeptide comprising:
      i) a second member of the inducible dimerization domain ($D^2$); and
      ii) a second polypeptide fragment of the sequence-specific nuclease ($N^2$); and
   wherein the first and second members of the inducible dimerization domain come together in the presence of an inducer agent or inducer signal, resulting in protein complementation of the two nuclease polypeptide fragments to form the active nuclease protein in the presence of the inducer agent or inducer signal;
   wherein the first ($N^1$) and second ($N^2$) nuclease polypeptide fragments are Cas13 endonuclease polypeptide fragments; and
   wherein a split site between the first ($N^1$) and second ($N^2$) nuclease polypeptide fragments is in a structured region of Cas13.

2. The system of claim 1, wherein there is a lag time of 30 seconds or less in between protein complementation of the two nuclease polypeptide fragments in the presence of the inducer agent or inducer signal and the nuclease protein being in its active state.

3. The system of claim 1, wherein $D^1$ and $D^2$ are selected from the group consisting of:
   a) $D^1$ and $D^2$ each comprising a VHH camelid antibody that specifically binds to caffeine (CaffVHH);

b) $D^1$ and $D^2$ each comprising a tandem VHH camelid antibody that specifically binds to caffeine (tandem CaffVHH);
c) $D^1$ comprising a GID1 domain or a fragment thereof, and $D^2$ comprising a GAI domain, wherein the GID1 domain and GAI domain bind to the inducer agent Gibberellin Ester (GIB);
d) $D^2$ comprising a GID1 domain or a fragment thereof, and $D^1$ comprising a GAI domain, wherein the GID1 domain and GAI domain bind to the inducer agent Gibberellin Ester (GIB);
e) $D^1$ comprising a FKBP domain or a fragment thereof, and $D^2$ comprising a FRB domain, wherein the FKBP domain and FRB domain bind to the inducer agent Rapalog (RAP);
f) $D^2$ comprising a FKBP domain or a fragment thereof, and $D^1$ comprising a FRB domain, wherein the FKBP domain and FRB domain bind to the inducer agent Rapalog (RAP);
g) $D^1$ comprising a PYL domain or a fragment thereof, and $D^2$ comprising an ABI domain, wherein the PYL domain and ABI domain bind to the inducer agent Abscisic acid (ABA);
h) $D^2$ comprising a PYL domain or a fragment thereof, and $D^1$ comprising an ABI domain, wherein the PYL domain and ABI domain bind to the inducer agent Abscisic acid (ABA);
i) $D^1$ comprising a Light-inducible dimerization domain (LIDD), wherein a LIDD dimerizes with a complementary LIDD ($D^2$) upon exposure to a light inducer signal of an appropriate wavelength;
j) $D^2$ comprising a Light-inducible dimerization domain (LIDD), wherein a LIDD dimerizes with a complementary LIDD ($D^1$) upon exposure to a light inducer signal of an appropriate wavelength;
k) $D^1$ comprises a repressible protease and $D^2$ comprises a reader domain, wherein the reader domain specifically binds to a repressible protease in the presence of a specific protease inhibitor; and
l) $D^2$ comprises a repressible protease and $D^1$ comprises a reader domain, wherein the reader domain specifically binds to a repressible protease in the presence of a specific protease inhibitor.

4. The system of claim 3, wherein:
a) the repressible protease is hepatitis C virus (HCV) nonstructural protein 3 (NS3);
b) the reader domain is DNCR and the protease inhibitor is danoprevir; and/or
c) the reader domain is GNCR and the protease inhibitor is grazoprevir.

5. The system of claim 1, wherein the first ($N^1$) and second ($N^2$) nuclease polypeptide fragments are Cas13d endonuclease polypeptide fragments, wherein $N^1$ and $N^2$ are selected from the group consisting of:
a) $N^1$ comprises a N-terminal polypeptide fragment of SEQ ID NO: 1 with the C-terminus ending at amino acid 384 of SEQ ID NO: 1 or ending at amino acid 384 of a polypeptide that is at least 95% identical to SEQ ID NO: 1, and $N^2$ comprises a C-terminal polypeptide fragment of SEQ ID NO: 1 with the N-terminus beginning at amino acid 385 of SEQ ID NO: 1 or beginning at amino acid 385 of a polypeptide that is at least 95% identical to SEQ ID NO: 1; and
b) $N^1$ comprises a N-terminal polypeptide fragment of SEQ ID NO: 1 with the C-terminus ending at amino acid 565 of SEQ ID NO: 1 or ending at amino acid 565 of a polypeptide that is at least 95% identical to SEQ ID NO: 1, and $N^2$ comprises a C-terminal polypeptide fragment of SEQ ID NO: 1 with the N-terminus beginning at amino acid 566 of SEQ ID NO: 1 or beginning at amino acid 566 of a polypeptide that is at least 95% identical to SEQ ID NO: 1.

6. The system of claim 1, wherein the first and/or second polypeptide further comprises:
a) at least one cytosolic sequestering domain, wherein the cytosolic sequestering domain comprises a ligand binding domain (LBD), wherein, in the presence of a ligand, the sequestering of the protein to the cytosol is inhibited;
b) at least one nuclear export signal (NES); or
c) at least one nuclear localization signal (NLS).

7. The system of claim 1, wherein the split site does not comprise a conserved residue of Cas13 compared to a plurality of Cas13 orthologs.

8. The system of claim 7, wherein the conserved residue is in a secondary structure of Cas13 or a catalytic domain of Cas13.

* * * * *